United States Patent 12,790,634 (MOST PROBABLE NUMBER ANALYSIS OF HETEROGENOUS POPULATIONS) - sequence listing, part 2

SEQ ID NO: 1 - DNA, 3477447 bp, unidentified (residues 1,738,725-3,477,447 of 3,477,447)
  source 1..3477447: mol_type = genomic DNA; note = Thomasclavelia sp000508865
aattctaatattattaaaattgatctttcctgattgtacagaagaatcaataataacatttttataatttctgatactacttgttccattcaaatcataattatcattaacaatatctgactgtgtaattgtcaaagtatcgcgataaaaccctttgtattcatcgcaaacatcaattatattttttacgacccaatccttttcttcactacttctttgtaaagaaccagccatttcttgagaaactgtataactagactgcatcaaagtctgattagaatatgcaatatcatcaccaattttaatgtatgctctagctgcatatcttgtattaaaattagaatttttaagtcccgtcaaaacacccgtaaaatacactttattattttctgttttaaaattttgaccagcaacaattttcataggagtataagttgtaccatttaatacatatttaccatcagcagttaactcagctcctctattggcttctaaaaccgatcctggtaatattattgtcccatattcaactgtttttccagctgtctttaattcatttaaataatcttgatcaatagatgaaataactcgtagtcctaatttatcatctatacgtatttccattgaatcaatatttaaattttcatcaactttagctggttctacagcaaataatactcctaaattcccaaaaatcatcgtaaatataagagttaagcttatccataactttttattttttatattcatttcctctctccttattctgttaaatcccatggtatttcagcctcattatcaccaaaagaatctacatttttatcttgagcgttttgatcaatatcttcatcactatctttactattattatcatctgtgtttttaaaatcttgttgaggaacaggatttctttctacagactgtttattttgaattcctttattacaaacttgacccaatataaatattccaataataattaaaatagtaataatgcccatgaatatcttttttttcactctaccaccttattaatcaatagataattagacaatctttaaatttggatagcttttaatctggtactccttcccaatcaccaccgatttctccatcattatcaccgattccactcattaaaataatatcttcagcattaaatttaataacatcaatttctggtactgcatagttttctttcataacattctccatcctttataatatttaataataggtaataactaacatgttgtaatatttagaataaatattacaatagcttataagctattgcgaatcaaaatattttttcatttcactcctttctgttatttttatcttcaaattcggttaaaacctctattattctatctaatctaaatataaattacaacatttatacatcatttccatcaattctttcatatctagcatttgttaactgcccacttcttgaaacttgttcttgagcatgaaaaacagttaaattagatgctaccatactagtagctaacaccaagcttaacccgattttcttgatgttttttaaactataaaacattttcctttccctccttgtcttaatagttcatcaatttgcaaataatcttaaaatatctcctccttacagcataacacttattctatttcatctccctctacaatagaacaagtgtaatatgctaaaaaatggtctaaattatcccacctgttaaattgtatcattttaaatacaatttttctttgtcctttttacatattaatttatacttttgataaattttaagaataatctattatcacaataaaaaacagtaagtatatttcttactgttgattcctatagttatcgcatattttttcctaaataataaaaacttgcatactgtccctttttctttaataattcatcatgagttccttcttctacgattccctcatgagataaaacacagatccttttagcatttttaatcgttgaaagacgatgagcaattactaaagtagttcgattctttgccagggcttctaaagattcttgaacaacatgctcactttcattatctaaagcgctcgttgcttcatcaaaaatcagaattggcggatttttcaaaaatactcgagcaatacttaatcgctgtttttgaccaccagataacttaacaccacgctgtccacaatctgtattataaccatcaggaagttccatgataaaatcatgagcattagcctttttagcagcctcgataacttcttcatcactagcttcaaagcagccataacgaatattatctaatattgttccggcaaataaatatacatcctgctgcacgattccgatgttctggcgcaatgaatttaactttatatctttaatattttgaccatcgatcaatatttttccctcactgacctcataaaatcttggtaacaaagaacaaatcgtagttttaccagcacctgatgatccaactaaggcaatatattcccctggatggattttcaaatttatattttttaaaacataatcactcttttgattgtatctaaaagctacattacaatattctattgatccttttacattttctaaattacgagcatcctttttatcttttatatctggttctatttctaagacttccataaatctctcaaaaccagtgatcccttcttgaaattgttccgtaaagttaatgaatttcttaacaggatcaatcaaattgttgatatacaacaaaaaggctactagatccgctacattaataatatctttagaaatgaaaatcgaaccaaagattgctgctgcaaccgtaatcatacttgtaaaagcacctaagcctgaatgaaattttcccatataaaaataactatttcttttactatttacatagttactattttcatcatgaaatttatttatctcatagtcttcatttccaaagctttttacaactctgattcctgataagttatcctcaattcgggcatttatgtcacctactctttgcttatttattttaaatgcttttttcatttttcgattatagtaataaataaaaccacccattacaggaataaaagcaaaaacgatcaaagttaattgaagatcaatattcactaaaatgataaaagcaccaaaaaacttaataagagaaatgacaatatcttcaggtccatgatgatataattctgtcaaagaaaataaatcattagttaaacgcgacattaactgcccagtcttttgttcatcataaaaactaaaagacagcttttgataatgcgtaaaaagttcatttctaagatcacgttccatataaacacccattacatgaccctgataagcaacaaaataattacatagatattctatgataactaatatgatcataaatattcccaatttataaatgacgctgatttcaaaattatgatcaactagaactgttcctgttaggtaacggatgatcatcggaaaaacaagagttattccagcagcaatcatggcacagaataaatccgctaaaaacaatcgtagatacgggcgataatatgataaaaattttcttcctctactacccatctaatgcatcccctttcatagttatctatcatatcataatttgtcaaagattttaagtaaaatagttttgttaagattttgttaatttattttacaaataatttacagaatcttaacattttattattattgtctttaggaggatgattttatgactttagcagatataaactggccgctgatattagcgggactggggctatttttatttggaattgaatatatgggggatggattaaaaggctattctggtgataaattgaaaaatattatcgacaaatatacttctagtccatttaaaggaatcttgattggagcttttgtaacctgtttaattcaatcaagttcgggaactactgcattggcgatcggtttgattcgttcaggcttaatgagccttgaacaatcaattggaataattatgggggccaatattggaactgttataacttctgtatttgttggtttaaaaatatctcaatatgctgtttattttataattattggtgcttttttcttgatgttttcaaagaacaaaaagactaaatatatgggacaagttatatttggctttggctgtttattttatggtctagaattaatgggcgataatttagccaatatttctaaagtacctgaatttagtcaagttgccaactatttgtcacaaaatccatggttaggattattaggtggcactcttttaactacagctgttcaatcatcagctgcagttattgcaattgctcaacaaatgtatggttcaggggcaatcgggctatcgattgcattaccatttctatttggtagtaacatcggtactaccataactgcggtgttagcttcatttggaggaactattccagctaaaagagctgcttttttccacgtcttatttaatgttgttggttcaattatatttatgttgattttaacaccttttacaatgctgatccaatggttagcaagttcattacatattttgccagaattacagttatcactagctcatggtatttttaacattgtaacaacaatattcttctttcctttgatcccttcaattgttaaactaatcaaaaaaattctaccaaacagtaaaaaagaaattaatatggatctaagcgagcttgatcaaaacgtcgtccatctatttcctagtcatgctctagaaatcgctaaaaataaaatcatcgaaatgggacatattacaatggaggctgtcgaaggaattcgtgcttattttgatactaaaaacagcactgctaaagatggtgtatatgagatggaaaatgccatcaatactttagatactaaaataacagattatttagttttaatttctcatgaaacattaaatgatcatgattctaatgattatttagctaatatgaaagcaataaaagattttgaaagaattggtgatctatgtattaatatcgtcaaatattatgaagctgtctatgatgaaaaggaagatttttcatcagaggcaagaaaagatcttgaaacgatgatggatatggtaattgatatgttgaatcgagctgtagtggcatttaatgatcataaattagaagatattgaatatgtagatgaaaaagaatctgatcttgattattttaataaaaaggctaaacaacggcatataaaacgtgttagtaataaaattgaaaaatcgactttagttaattccacttatgttgatattttagctaatttagagcgtatgggtgatcattgtcaaaatattgctgaagcttatgtgcttgaagaagctgcttatataagtgaagagccagaatctgctttttctaagtaaaaccatgtttaacatggttttactttattatttcaccaaaaaatgatactctatactatagaaaaggagttatctatgaaaataaaattaacaaattatgatacaagtgaatataaactattggaaactaagctcaatgacttatctaaacaaggttataattgtgataatgctgatttctttaccgtttttaaacatgatgatgaacgtttttattataaaacagatatttttattcctaataaaaatagtcatcaaaaaaaccgtgaacagcgtgataagtggctattaaattatcttgatcatggttataaatttattggtaaaacgcataaaatatatgtttttaaaaataaaaaagatgtaaaggtcaaagaaactgataaaaaactattactcaattattttaaaaagaataaaacattatataatattttatttgtctttattagcttatttttatcttttttattgattcccaatgtttttataaacaatgaaccaaatgaatttatcaccaatggtgctattttgatccattatgccccgctaatgctatgtatttcattgatagtccgctccattagcaattatcttcaaactgaaaaaattaaaaataaacttgttaaatcgattgctttaaaaccagctaaaatacagcagtatcgttttattttatcaaactggctttttattatttctattttgatgattattagcggtttttcactagatgttatcgaaagaaaaaacattcctataacagataatattttaactttaaatgatttaggctattctagtgaacctagtgatacatatactaaaagttctagtttaatgatcaaagaagcatctagttattttgaaagtaatgatgatgaaattttaaaaattaattattattgtttttcttctaatgataaagctaataaatatttaaataattatttaaatgtttataattatgaaaagaaaaagcaaatagctaatggctatttactttctaatgattctttttataataacattatttttgttcaagataaacagttgattattattcaaacatcttttgatttattagaaaatgatctttatcaaaaaatacttgattttaattactagtctcgttttaaacgagactatttttataatttagttaataatttgattacttcatcaatttttttatctgcatcatgttcattaatagcattttttacacaatgatttaaatgatttgataaaacttcattattagcatttttaattaatgactgtatcgcaagtaactgattagaaatatcaatacaatatcgatcatcttcaatcattttaataacagcatcaatttgtcctcgcgctgtttttaaacgcaacaatactttttcattagacattattgatttccactaccttatatccggctttctccaccgctgcttttaaaacagaatcatctaaagttgtttcaacaattgcattattagcttccaaatcaacaactgcatttgtatcagctaaattgtttaaagcttcttcaacatgttttttacacatttgacacatcataccttcaattttaatttcttttttcatctttttattctcctttttataatatggtttaaaacgttttaatctaagagcattacttacaacacaaacagatgaaagtgacatacacaatgaaccaatcatcgcatctaaacgtaatcctaataaatgatagaaaactccagcagcaataggaattccaattatattatatataaaagcccaaaatagattctctttgatatttaaaattgtcttttttgacaattcgattgaagaaacaatatctcgcatatcatccttcattaaaataacatcagcagcatcaatagcaatatcattacctttaccaatagcaacaccaacgtcactgcgaaccaacgctggagcatcatttattccatcgcctaccatcataacactattaccctgactttgtaactttttaattacattttctttatcctgtggtaatacttcagcaataacttcatctaatcctaattgttgattaatagcattagctgatgtttttaaatcaccagtaagcattactgttttgatcttcatctcttttaaacgctcaattgcctgtttactagtttgttttatttcatcaaaaatactcactaaaccaattaatttattttcactagctagaaaaactaatgttttaccttgagctacaaaactatctattttatcttgataatcactaaaatcaatcttattttctttgatcattctaagatttccgactaaataatcttgatttaaaactgttcccttgatccctaatccacttaatgattcaaacttatcagtttcaatcaattcaatatttaattcctcagctttttgaataaaagcatcagctaaaatatgactagaacctttttccaaagatgcaatgatcttaattacttcttcattagctaaactgttgctataaacatcactaacctgtgcttttccttgggtcaaagtcccagttttatcaaaaacaacaacatcaatattattctcattttctaagacactagcacttttgatcaagatcccatttgtagccccaactccggtagaaaccataattgctactggagtcgctaaacctaatgcacatggacaagaaataactaatacagcaatagcattggtaattgcaaaattcaatcccattcccgcaatcagccaataaataaatgttatgattgcaataatgattactgtaggaacaaaatattttactactctatcaatcattcttgtcattggtgctttggaactagaggcttcttcaactaactcgattattttagctaaagtactatcttcaactgttttagttacctcatatataaaacttccctgaagattatttgttcctccaattactaaactagcaacttctttttcaaccggtaaactttctccagtgatcattgattcatcaactgaactaaatccttgaatgatttttccgtcaacgggaatcgtttcattagctttgactaaaacgtggtcattgattttgagctcagaaatcttaacgatttcctcatttccatcatttactcgacacgctacatcaggtgctaactctaataatcgacttatggcatctgttgttttcttttttgattttgcttctaaatatttaccaaaactgattaaagtaacgatcattcctgctgattctaaatatatattgtgaaccaaatgcatttccatcattgaaccagttagactcaaaactaaagaatataaactatatataattgccgcacctgagcctaaggcaatcaatgaatccatcgttggatctaaatgaatcaaattcttaaagccgttaataaaataatctttcttcaaaattaaaatcggaattaaaaaaatagtctgtaaagcaaaattaatataactattttctctaataaaagcaggtattggataattaaacatcgatgacatcgaaacgtacatcaataaagctaaagcaataaaacaataaataagacgtttttttaaatcacttaaatcatcattatctactaaactctcatcaaacaaactcgcttgatagccaccatcatttacagccttaataatcagggtatcactaactttaccttcatcataatcaacattcatcgaattagtcaataaatttacttctacattattgacccctggtaatttacaaacactattataaacgtggttttcacaagcagaacatgtcattcctttaacactatatttctgtttcatatttccctccttacccctccctagggggtacgattatagtataaatgataatcttagaaattgcaaaagaaatgcataaaaaaactattacaaaaagtaatagttaataaaatgttgcaacctccgcaactgatttacgtttcggacgatcaggttcaatatcaccaatgcctaatgcaataacagcaacaattatttcttctgtaggaatatttagcatttctctgatttttttctcatcacgtattcccatgatcaaagttgccaatcctaattctgttgcttttaaaatcatattttgattatgaagtcctaaatcatagcaaccccagccattagccaactcattgctaggactaccatctcgttcaaaaccagaacgatctttaacaaaagtagtaacgatcaaaacaggtgcatctttacaattttcttgattaaattctggtaaacatgtgtttttaaaggtttctaataattcttttgagctaattacatgatatcgcgctgtctgactgtttttccaagatggtgcttcgattcctgcttgaatgatttgtttgattttttctaaatcaacagtttcatttttatattttctaatactacgacgttgttcaataacactttctaattccatttttattcccctttttttactattatagcataaataggctaattattagcctatttattatttatttaattcaatcattaaatcacaaattttatttgagaattcaactggattatcaattgagaatccttcaatcaataatgcttgatcatataaaatacttgcatagtctccaactttatctttgttattttcataaacctttttcatcgcattgaaaatatcgtgatttggattgatttctaaaattcttcctgctttaacattattaccttcaggcatttgatttaaaaccttttccatttcaaatgataccccatcgcttgatactaagcatactggatgtgattttaaacgtgaagatactttaacatcaacaactttatcacctaatgaatctttgattgctgtcaataaatctttattttcttcattagtcttttctaattgtttcttttcttcttctgtttcaatatctaaatcaccttgagccacagatttaaatggtttttctttataatctcgcatcatttgaaaacagaactcatcaacattgtcagttaaatataagacatcataacctttatctttaactagttccacttgtggtaaagtagcgatcttttccctagtttcaccacttgcaaaataaatttctttttgtccttcaggcatattttcaacatattgagccaaagtaataagtttttcttctttactagaatagtataataatagatcttgaagtttttcttttaacattccataactattataaataccaaatttcaactgtaaaccaaagctatcaaaaaattcttcatatttttcacgatctttttttagcattgtttctaattcactttgaatcttcttttcaatcttatcagcaatcacctttagttgacgatcatgctgtaacatttctcgtgagatatttaatgataggtcttcagaatctactaatcctttaacaaatctaaaatgctcaggtactaattcactagctttatccataataaagacaccacgtgaatataattgtaatcctttttcatattcatttgagtagtaattcatcggtggtttagaaggtataaacaatattgaatcatatgacacattaccttcaacacgagtatgaatcactttcaatggatcattgaaatcattaaatttatctttatagaactcattgtattcttcatctgtaatatcttttttatttcttttccataaaggtaccattgaatttaatgtttgattttcaattacatcttcatattcatcactatcttcttttttcttagaaacagtcatatccattttaattggataatgaacataatcagaatatttctttactaaatcacgaatatgatactgatttacatattcatcataattttcatcttcagtattatcttttaaatataatttgatcgttgttccatgttcactaacatctgtttcaaaaatttcataaccatcactaacttcagatacccaagtatgtccctgatcactaccatattttttagaaattacttctacttttttagcgaccataaaagcagcatagaaaccaactccaaattgaccaataatatcaatatcatcatgatcattttcatttttgaactcaaaagatccactattagcaatcgtacctagatgagtttctaattcatctttatccatcccgattccatgatctttaattgttaaaacacgtttatctttatctaaaccaatttcgatattcaaatcatcacgattaattgatgaaatattttcagtaagtgctttataatataatttatcacttgcatcacttgcattagaaattaactctcttaaaaaaatttctttatgtgtataaatagaattaatcattaaatctaataatctttttgattccgctttgaattgtttcttttcagccataattacatctccattcttatattagcactcatctttcttttgtgctaaagctattttaatacaacgtcttagcactgtcaacccccgagtgctagttttttaaatttttttgctaaactttatatttaataaacatttattattttgaactcagttttttatgcataaacgcaataaaactttgaattccgataactgctaataaaatataatatggtgaatacaaaaacaaatatctggctcttgcttcaaacaacaataaaaataaggtaattccaataattgccaaaacaattacatatatatcttttttatcagtattagcaattcttttaactgcaagcagaataaaaaataaaatcgttatccaaatactttgttgataggttgcataacttttgtagtataagccatcataataataaatatctcgcaatattttagcactagaattattgggtgcttctaaaacagtaagataaaaaccgccttcaacactccaggcaaaagtaccatcattataattagtcatcaacttctcacctaataatttaaaatatccagaaatgccataatcttctaatcttttttttaccatttctaaattagccttgattttttcttcttttccgataaacgaagctgtatacatcacatcatcttcataataaacaccttttgtaactggattcatccccatcatcaaaaaatgggtaagtggaaaagcatcagcttcattttcttcataaccgatataattattagaataatttttaatagtcaaaaaaaccatcatacaagaaagtaatactaataaaaatctagtacattttaattttcgcttattactataaaaaacaaatttccaaaattccactaacatgattgcaattaaaataatgatacaggttggtttaattaaatagccaatcaatgataagataaaaattaaactccaggctaaatattcattcatattctttcgatttaaataaaagtataaaactgctgtggtaaaaataattgaataactatctgaataaggaattgttatccatggtgataaagcaatataaatactataaataaacaatgttaaaactgaataatatctatttttaaaaataattgcagcacttttagtaataaaccaagctgagatattcaccaataaaacacttattacaactagtgaaaaatcaagattttctatttttaaaaatatcgcgacttctttaattattgtaaagataaatgttaaaaagacattattaggatatcttgtaaaataaccataatttacatactgcgaatttaaaagctgctgattcgctaaatcagttgaagtatttcttaaaatagaaacatcccaccctgataaaaaataaatattataagctatatataattgaataattaataaaataatacaagcagcaatcagtaagatattacattctcttttagataatttattaatatgtcttctaaaaaagatattataaatcgtccccaagactagtacccctattattcctaaaatcaacaataccccattagacatagttacattatttttacatgcataatccataccttgagaaaatataatattcattcctaaaatcattaaaatcataattccaaataatccaattattattttataaaaaacgcttgaaatattttctttatcacgcattatgatcacctgtttttacattactatttttaaatccataactgttaaattattcctaaattaacaaaaccatcataaactccatcttcatcaacactcttacatatacttgaagctatttctttaagttttgcattgccatttgccataaccacaccatgatcaacaaaatcaatcatttcataatcattcatactatcaccaaaagcaatagtatcttttatatcaatatttagataatcaattgcatattgaattcctgtagctttattatctgtctttgaaattaactctccgttgatcgtagtttcatcaaacatctcatgaattactatattaacatcatcttttaattgttttaaagcattatcaagtttttcttgatttaatgaaataaaacaaatcttatgaactccttgattagtgtaagtatttatatctttgatattaaacttatcatgctgttgagcttttaaacgttcaaattcagaattgcctatttcaaaatttattcctccaacaaataactgaaccatcttatctgacgtaaaagtcattgttgtacattcataattataataaatattaaatttatcaaaaatacttgtaattttattaactaatgaattatcaaagtatgcactatgtactactttgttattgatttctacgtagctaccagcactagcaataataccatcaaattcaactgcatttaactcattttttataccagctttatttctacccgtacaaataaaaactttatgtccattttcacgagccttttttatcccttcttttactttttcgctcatttctcgatgattagctactaaagttccatcaacatctaaaaaaattgcttttttattcataagccctcctaaaatataatttatttcattatacaactattgtaataatttttcttcttttttacaaataaaaaaggaagtgtatcaacacttcctagcatgatcatgatgataagtatcaactaaattacttttactattacacaagccgccacagctattacaattaccaccacaacttgacttgccattagctttatctttcctaattgaacgtatcgctaaaactactgcaaacacaataattaaactcactaaaatcgttgaaaaattttcatttagccataccatcattaacatctcctctatttttgagtaactacgttatctaaattaacatcaagatttttactttctttatatggacgaactaataaatagataaatccaatcactactacaattgcaataatcgttgcgatcgtaaatgatcctgtaatgatcgtattaccgatctgatatacagaaaatgctactaagtaagcaaatacagtttgataaacaattgcaaaagcagtccatttaccattgttcatttctctttttattgctccgatagcggcaaaacatggagcacaaagtaaattgaaaatcaagaatgaaaatgctgcaatttgagtataacttgaagctaatgtaccccaaatctcggcaccatcttcggcaacttcagcaaatccataaagaataccaaatgtaccaacaacattttctttagctactaatcctgtaattgcagcaactgcagccttccaatcaccccaaccaagtggtgtaaagatccaagcaattaaattaccaatagaagctaaaatactatgatctaattgagtatcttcaagcattgtgaactgaccatcgacaaatccaaaataagaagtaaaccaaactaaaatagtagataataagataattgtaccagcttttttaataaatgaccatcctctttcccacatacttcttaaaacatttaaaagagtaggcatatgataagcaggtaactccattacgaatggtgctggatctccagcaaaacgttttgttttctttaaaataataccagaagtaatgattgcggcaataccaataaaatatgctgcaggggcaacccaagaagcaccattaaataacgctccagcaatcaatgcaataattggtaacttagcaccacaaggaataaatgtagtagtcatgatcgtcattttacgatcacgatcgttttcaatcgttcttgaagccattaccccaggaactccacaaccagtaccaattaacatcggaataaatgatttacctgataaaccgaattttctaaaaatacggtccatgataaaggcaacacgtgccatataaccacatgattcaagaatcgctaaaaagaagaataataccagcatttgaggtacaaatcctaatacggcaccaactccggctacaataccatctaagatcaaaccattaagccaagcagcagttcctaacgattctaataatccttcaatcaaacttggaattgatggaatagctaaaccaaataaactccatccatctccaaacacaccatcattagcccaatcagtagcccatgtaccaacagtgctgacagaaacataataaactatatacataattaccgcaaaaatcggtaaagctaaccagcggttagtaacaattctatcgattttatcagaaatcgataattcttcattatttccttttttataacaatcattaattattgaagtaatgaactgatatctttcattagtaataatactttcagcatcatcatcaaattctttttcagttttaacgatagttgcctcaacattaggaactgtgctcattaaacctgtaattttatcatcacgttcgaataatttaatagcataaaaacgtttttgttcttcaggaatatctcctggaagcatcatcgcaatattatctaattccttttcaactgctttatcaaatttatgaactggcatattaatattttttgaacgtgctaattttactgcctgatcagctgcttctttgattcctgttccttttaaagctgaaatctcaactacttgacagcctaattcattagataactttctaatattgatcttatcaccttttttattaacaagatccatcatattaattgccatcaaaaccggaattcctaattccatgatttgtgttgttaaataaagatttctttctaagttagtaccatctacgatattaataattgcatctggacgctcttgaattaaataattacgagctacaacttcttctaatgtataaggtgataaagaataaattcctggcaagtccattaatttaacatctttatttccttttaatttcccctcttttttctctaccgttactcctggccagtttcccacaaactgattagaaccagttaaggcattaaatagtgttgtctttccactattcggattacctgctaacgcaattgtaattgacattttttcaccctcctataagacttcaatcatggcagcatctgctttacgtaaagataattcataacctcttacctttacttcaattggatcacctaatggcgcaactttgcgcacaaatacttctgtacctttagtgattcccatatccatgattcttcttttgacagcaccatcaccatgtagttttactactttagtacttgtaccgcattttacatctcttagtgtcttcaccgattaatcccccttaaatcataatcttattagccatttcctgactaatcgcaactcttgattctttaattttagtaattaaatttccttgattcttacttacaacagtgacagtggtgcccactgtaaaaccaagtgattctaaaaataactttacttcttgttttccaccaacttttttgatagtttgtgcttcaccaatatttgccatagttaaaggcatcatcaccacttcctcacttttctgttagttatatctaactatgtttatgttataccccgctaactaaaatgtcaatactatcacataaaaaagttagaatattttaactcaaaatttaaaatagtttataaaaaaccagagcatttattaatgctctggaattgataaaactttatatttcaacgatttgaccatcattgattttcaactgtacatcacactttttagctaatgaaggtgaatgagtaacaataataacacatttattattgttatgtgccaattcaataaacgcttttaaaatctctcgagaatttttttcatcaagattaccagttggttcatcagctaaaatcaaatcaacatctttagctattgcacgagcaatcgcaactctttgctgctgtcctccagataattttctaatatcacgaaggcattgttctttagataatcctaaatcatttaaaatttttaaacaatattcttttttgttaggaatctttaccccagcaatttcaatagcattgacaacattttcataagcattcatataatgaatcaaattatatgattgaaaaacgattgaaatattgttacgacgatatttattaagacctatttttgcagtgtctgtccctttgaaaaagaccttgccgcttttgggtttatctaaaccgccagctaaaataatcgttgtcgtttttccactaccactagctcctacgattgcatatattttccctttttgaaaactataatttgctttatctaaaatcgttacattactagaaccatccaaataatggtatgaaacatcttcaaattctaatattgtttccatattacccctcctttttcactagaatttctctaggtgatagtctaagtatataagctgatggaatcacgattgaaactaagcaaatagcagcagtaatacctgctaatttagctgctgtcggcacggttaaagaaacatctaattctgtattctccggcccgctaaaagcatcattaaacattcttcttccaaactttgaaacttctgctccttgatccaaattactatctgctgtttcttgatcaactgcaggtatttccatttgaacatgattatcgttagttcctgcttcaagcatattcccaacaagattagaaaccattttccctgttcctaaagaaattacaaatgcaactgctgctactagaagcatttccaataattgttgtaaaattattttgattttactttgtccaagagacaagaaaactccaatttcataatatcgatttctaatagttaaaattaagatcaaacataatattgcgcttccagccccaataacaacgattaaaaatattgttgcaaatgattgagtattttctaaactgtttatattttgctgatacaagcgatcatttgcatctaaactataagtttcaaaatcaatatcacttttttctttagctaattcttgaaaagcttccaaattttctggatcgtctaaataataaactgctgatgttagatcagaatcacttcccaaaaaaagttgaccaattgataaatctgtataaattgtattaaaaggattactttgaccaggtcctcctatttgttgtgaatcgttcacttcataaattccgacaatcgttaagtcatgactaatcgtttcatcattaactgtagctgttagtgttattgtatcacctacatctaagtcattatcacttgctaaagtcgtttcaataacacaattattagttccagcatcatttgctgataataatctcccctcgattaaagtacttttctcttcgctaaaagtatctatatattccattgttgtattagcgctgattgaaaactcaccctgattactatcaaatcctccttgaaagttatcaggtttttgcttattaccttgcataccaccttcactttgattttcttcatctgcagtaagttcaactggatcaatagtgtcactatcagctgaagttgaaatgttgtaattgtaactcttcacatattgtagattttttaattgatcagccattgcaattgtaacgcttgccctaacttcatctacagcctgccccttttctctttgattcatcatgtttttcatattcgttgtcaaagtaacatcactaccaagtgttgaacgaatttgatccattgatttttttgatgcactttgtattgataatccagcaattattaaatttgcaatcacgatcataattacaaataataaaattgttttaccaatattttttctaatacttagaaatgcattttttaacatacctctacctcctagtatcaatatatcaaaacaaatatattggtaaaatcgtacaaatatgtgaaaaaaagtaatcctaaaggtaatttatctttatagctatcaaatgccttattttttatcgctatatttattttaaacaaaaaagtctttagaatcttcatttacatgaaaattccaaagacatgttatttatgcttttattttagaatttttcttatttcctgatacaacaatgttatcatcacctaattgatcttttgcattttgattattagattgttgctcgtgttttggtttattcataaattcacctcaataatagtatccccaatttattttaaaaaattcaaaattttaaaaaaaataaagagatggtcacccatctctattcatctccaaaacaaattccaattgctttagccgcttttactaattcaccatttggatcaacgtgtttttgtctaccaaattttgcatctccaattacttcttctaaagaagtatatgacatattttcaccttttaaagtaactacattaccaaacttaccttctttgataagttctaatgctttgactccaaaacgaattgataaaatacgatcatatgattgaatatctccgccacgaataatatgtcctggatttacagaacgtacttcatgatttggaattgccttttccaaatcatcagcaacttttgcggcaataccacctaaacgaattggatctggactatcttcaacaatttttccaattacttttgtaccatcagcatatttagcaccttcagcaacagcaattactgtatatggatatccttcttcatcacgtttagcaacatgttttacaatattatcaattgtaaaaggaatttctggaatcaaaatacatgaagcatttccggccattcctgaatataaagcgatccatccagcatcacgacccattaactcacaacaaataactcgatgatgagatttagctgtcgtatttaaacgatcaataaattctgtacctactgaagaagcactaataaatccatatgttagatctgttgctggtagatcattatccattgttttaggaattccaattacattaacaccttttcgtgaaaaatcacgggcacttgtcaatgttccatcaccacctaaaacaactaatacgtcaacaccagctttttttaaattttcaaccccaacatctgaaacgtcttttttaacttttccaccatttccatcatcaacaagataatcaaataaattatctttattagaactaaataaaatagttccaccttctttataaatattttctaccttgtcaactgtcaattctatgtaatcattgttatataaaccgcggtatccataaacataaccaataacttcatacccgtattcgttaattgcagcttttgttaccgctctgataactgcattcaaacctggacagtctccaccaccagataataatgcgattctttttacgtctgccataaacatccctccatgtattatattataattttttttttactgaaacacaacaaaaatgttaccgtttccataaaataataacattattattcataattgtatagaattttattctataaaattctattttttaaatagctttcaatgattttaaccggcaaaccaatgacagtttcaatatctccatctatttcagtcactaaacttcttccagtcccttgaatagcatatgctcctgctttgccctgccattcgcttgtatttaaataatcattaatttcctgatctgttaaatctttaaaagtcactttagtactatcatgataagtgttaactttattattatctatgatagcaaccgcagaataaacgatttgtgtcagattagacaattgttttaacattttaaaagcttcatcacgatcacgcggctttcctaacatcttttcttttaaacataccattgtatcagccccaacaactatatcattgggatatttcaatgatataggtaaagctttttgataggctaatttctccaaacgtaaaggaagtgctagcttttcatctaacacttcatctatttctacataatcaattataaaatcaattttatgtaattctaaaagctcttttcttctaggtgagctactagctaaaataatttttttcattattctgctttactttcttctttttttacaggtttaggaagcaaagcttttctagaaacattaacttttcctttttcgtcaaccttagtaactttaactttaataatatctccaagctttactacttcacccatttttttagttctttcataagcataatcagaaatatgtaagaatccgtctgttccatcaaataaatttacaaaagcataattatcttcaactctaacgatcttaccatcatatacttcaccaactttagcctttttaacaattttttctattaatgctatcgccttattgatcgcttcttgatcataatgataaataataactgttccatcctgctcaatatcaattttaacaccatcagactgttcaataatttcattaattgtttttccaccctgaccaataactgatttaatttgatctggttcaatcttcatcatctgaacttttggcgcatatggtgataactgtgctcttggctcactaattgcttctaacatattagccataatctgttttcgagctactttagcttgagccaaagcctcttgtaaaatttctttagtaattccatctatcttaatatccatttgtaaagcacatattcccttttccgttccagcaactttaaaatccatatctcctaaatgatcttccatcccttggatatctgttaaaattgtataatcatcaccctttttaactaatcccatggcaacaccagcaactggagccttgatcggtactcctgctgccattaatgacattgtcgaagcacagatagatgcttgagacgatgaaccattagattctaatacttctgaaacaactctaatcgtatatgggaaagtatcttcaccaggaataacctgtgccaaagctctttcaccaagcgctccatgccctatttcacgacgacctggcgcccccattctaccaacttcaccaactgaatatggtggaaaattataatgatgcataaaacgtttttgatcttctagtcctaaaccatcaattttttgatgttcaccgattgcccccaaagttgtcactgataaaacctgtgtttccccacgtgtaaataaagctgaaccatgaactctcggtaataagtcgacttgtgaatccaacggtctgatttcatcaagcttacgtccatcaggtctaatcttttcttcagtaattaaacgacgaacctcatctttttctaaatcatgtaaaatgattccgacttgtttcattacattagcttttatttcttcattttcatattctctattatcatattcttcagtcacttgagcaactaattcatcaattgctccatatctttctaacttcccaggaatcgaaacagcagccaccatttctgcttttgcccgatttgaaatttcttcaactaaatcaacatctaattcaaataaaggaatttctaatttttcttttccacaagcttccacgattttttcctggaatgcaatcaattctttaattttttcatgaccaaataacaaagcctctaacatgacttcttcacttacttctttagcatctgcttcaaccatattaatggcatctttagttcctgctacttctaaattaattaatgatctttctaattgttcaggcgttccgttaacaataaattcaccatcaaccaagccaacattgaccccagcaatcggcccattaaaaggaatatcagaaacacataaggccaatgacgctcctaacatcgcagccatttctggagttgcatcttgatcgactgataaaacagtattaacactttgaacttcatttctaaaaccatccgcaaataacggtctaattggtcggtcgatcattcttgctgtcaatgttccatgctcacttgggcgcccttctctttttaaaaatcctcctggaatctttccaacagaatataatttctcttcataagtcactgttagtggaaaaaagtcaacatcttttggttcttttccggcaacaacagtagataaaataactgtatcattatatcttactaatacagatccattagcttgtttagctaattctccaatttccacacttagatttttaccataaaaatccatactaaacacttgtttactcattctttcacctcatctattatcttagccattataacatataaatttctatttcaaaacaatttattacttaactactgcaaaaccgtttaaaaaaatgttataatactaatcagaggtgattttatgaatgaaaacgaattaaaaagcttagaggtatacaatgcaaaatttaaagaagatcctacttctttcaatgatttccaagctaacgactacatcaaattattgaaaaaaagcgacaacaacgaagaagcaattgaagttggaaaaacatttttgtctttgtgcccaaacttaagaggatttttaaaccagtatggttatgctctttacaacaaattcatcaacattgatgataacgaaattaaagaaaatgaaacacttttctttagtgtccttgatgatatcttggctatctgtaaacaagaaagatactcaccaatggaaccatctgtaaatcgagcaattaagtatttgcaaagagaaaaaccaaaagattgtgaaaaattaattgagatgcttgatttactagatccaaatctactagatgataaaccatttactaatcttgaaggaaaagaatttgaatctaaaaaagaacgttactatcgtttaaaagtaaaagctctatacgaagctaaaaaatacaaagaatgtgtagaaacagcaaacaatgcactatctttacctttgaaatggcattttaacacattacaatggatcaattatcaaagagcttgttcattagttgaattagaacaatatgaagaagctaagaaaatctttttatctctacataatcgtatccgtaatattaacttttacgaggttttatataaaacaaatgctaacatcggtaatatcaaagaagctaacgcttatttattatatgaattctttgaaaatggctatagcattgatcatttaggaatttatctaagattaaaagaggcaacaaaaagaactaacgatcctgaattaatcgaaatcgttgatctttttttaacaaaactttgtcaagaaaacaacaaagaatatactccagaaaatgatcatggcgataaatacaaagaccaagattctagtgagctttacgacattatgtatgaaaaaatcatgaatagtcttgataaatatgttgaaagagttgaaggtacagtagttcattacaacaatcaaaaagcattaggaactatttcaaaatatgatgaagatggcattttctttagacaagctgattatgtttatgatgaagaagttcaacgtcgtgataaagttgaatatactccaattgaaacttttgacaacaaaaaaggtgttgttaccagcaaagctattttaatcgtaacaactgaagaatatttagactttggttactaaaaacaaaactaacagaagaattatcaatttcttctgttttttgtttaatttacttatttaagcatatgtagtaattgtttaatgattgtctgaaaaatatctaaaaataatttacacatttttcttgacaaaagtatctatataaaaaaaagaaatttcttattctattaaaaataccacagttttcgaaatttccttttaatattataaattttcttaataagtattatctactttttgtttaaacactgcaaaatcatcttcttcaaatatatattcatatattaattctatttgcttttcactcaatccttctacccattcctggcagtcttgatgatattgcttttttaatatcttgatgcatctttgtttttctttttttaaagtttcttttttgcctatttcaactccttcttctcgtccaatctcattcccttgttcgataccttttttgattccctcttcgattcttttggctgtcttttcttcgcgctccatctctaaggattcggttctaagcttcgctaacgctaactgattcgctaatgaccatatcggctcattacttctaaacttgtcatacatctttatcaccatctccactatatcttcttctctttccttcattatagcagtgtattcattttttataaacaaataacataatctttctagatcatttaatccttcaattcctttttctttgatgatcttatcgatatgtctcatcttgataaaatagcgatagttaagattttctttttccagctctccctgatcatctcgaaacgcataatctttgatcaaacgatcatcatcttcattgataaagatgatttgatatactggtcttagctgatgatatttttcaccggtatcgatctgttctactaacagtctagcaccatagaactgaaagcgggtgctttcgctattactgttgccggccatctgcatttcgatatcaatgattcggcccttttcatcaaccgcacagatatcaaggatgatatttttagcgagaaccgtattttgattgatttccggatttttaacgatcatctgttggcagtcaagatgagtgacagatttaacgataaactttctcagttttatagattctaaagtgtccctggaaagcagatatttaaagaacagatcattactaaagctaacattattgttattatcgataatagttttttcatgaatcatattttttcctcctcattatcttttacaatctaaaaaggagaattacttttataaatttaaattttagtaaaatattattcaaaaaataacatctgctatttaattaatatctaatatacatcctgcctcagttatttttttcatcaatgattctggtaataatgtattagtaataataaaattgattgcattccaattcaaagctttgtatgaacttgtctttaaaaacttgctatcatcgacaactaaacaaacacttgcacttctcgatgctacttttttctttattgcagcatcttcatattcttcaacatatataccatcttcttttattgccgcagcaccaataaaagcaacatcaaaatatatattatccagcatttctaatgcctgacttccatacatataacgattataattattatattttccaccaatcatatgagcattacaataattagctagtttttcaatgttatcaagtgaatgactataagcttctattttattaggaaccatttcacacatttcttcaatcgttgttgaaacatcaaaaaaacaaactttatgatcattaagatatttaattgctctaatagcaagttccttttttatttccttattcttaacttgccgattatgataattatcaattggactatgtaatgaagttaaagttattccaccatgagtacgtgttgccaatccttcattaactaatttgataatatctcttcttgcagtatctctagaaatattaaatttattcataatatcttgatttgttaaagttttctcttttttcaataattccaatatctgataaactctttcttcttgatacattataaatctattccttatcaattaaattttctaaagcataaactattccatcttgatcattggatttcgtatgtctagcaatttggtttaaaacatcttgcggtgcattagccataacaaaaccactccctgtagctagaagcatgtcaatatcattataattatctccaaatgaaacagtctttgtaacatcgatattaagcttttcacacaatatatttatggcattagcttttgaaatacttttatccataatctctaaataagtctcttttgatttataaacagataagaaatcatatttctttaacaatgcctgttcaactaaatcaacagtatttttatcacccatacataaaatcttatgaacaatatcgattttactaaaatctaatttctctggtgtgattcctgttatatcagcttcttgtttgacccaaggattttttaaatcactgctcatccaataatcattactgcaaatattaacactgatttgataatttttttcaataaattcagaaatttgtttggcattctctacagatattcctcttgaatataaaatctcattatctttgttgattactagtccaccactataactgattatcgggatatgaatatctaactgatccattactgtctttatcccacttggcgttcgtgctgaaaccagaacaaaaggtatcccctgattcactaactcatgaactttcattttcgtcctatttgtaacttcatgttgagaatttaacaaagttccatcaatatcactaaatacacattgatatttcatttttccacctcctaaccattattatacttaaaaataattataattcaatacatatacttaaaaatacttaaaaatacttaaagaaaaaagcatctttgatgctttaatcttttttcatatattccctcattgctttaatactttcatctgaaataacatgttcaattaaacacgcgtctttatcagcaattttttcatcaatatgtaaaacctctacaaacagctgtttgattgtctgatgtttactgcaaataaactttgccgtcttcttacctttagctgttaacttgatatctgcatatttttcataatcaacataaccatttttggccaatacaacaactgcattattaacactaggtttagaaactcccagctgtctagcaatatcactcacacgggctttttttccatctaaagataattcataaatcaattctaaatagttttgcatagcaattgtcatttcttccatctataatcacctcatttgtttaatcataccacataattttagagggaacaaacacaaatgcccatatcttataaaattaattacataataataaatgaggtgaaataatggaatatatcctatcattaagtccttttattattgtattgatcgtagcaacgtttaactggttaatgacatttttaggtgcatcactagtattatttgtcaaaagtgctagtaaaaaattagtttgtatagctttgggcagttccgctggaattatgattgcagcatcatttttttctcttattttaccagcaaaagaacaacttgaaagcactggtaaattgaatttattgatcataccggttggttttatttgtggtgttagtttattaatgttaattgataaattacttccccatgaacatatgatgtctcatgttcaagaaggaatcaaccctgatcactattctaaaaacaaattgttgatgttagcgatgacattgcataatattcctgaaggtttagcagttggtgtagcatttgcaggatgtcaaaatgaaaattatttagctgctttgattttagcaattggtattggcattcaaaattttcctgaaggaacggcaatatctttaccaatgcatcaatgtggaaaaagtcgttttaaagcaatgatgtatggtcagttttcggctcttgtcgaagtaccagcagcacttctaggatatgcctttgcgacactgataaatggtatcttaccatttgctttgtgttttgctgctggagcgatgatgtttgtttgtattgaagaattaattcctgaagctaatgcaacagaaggaatcgacttagggacaattagttttatggttggttttgtcattatgatgtcacttgatattttactttcttaatgtttttaatttttatcacttattgacaaatcgataatgataacgtatcataatagtaacaatttattaaacaaagacaatgaagtgaactagtaaatataacttagatatcagagacattgtggatggtgcaaacaatgcgttaaggaatattgaattcatcacggagtcggatgctgatatgtaggtaatcatcggttactagccgttatcgtagttaagttttatacttactgagattattagtgtgaactaataatgaatttggggtggtaccacgactctgtcgtcctctttggaggactttttttgtttaataattaaaaatatggagggattatttatgaaaaaactattaaaaggtttattggcttttgccattgttcttgttatcactggatgtggtactggtaacgaagataatgctaaagcaaaagatttatctgaagtcaagattggagttatccaattaatgcaacatgacgcacttgatgcttcatacaaaggttttaaagatgaattggttaaagcaggtataaatgctgataatattgattatcaagttgctggtgatcaatctaactgtactactgttgctgataaattagttaatggtggtaatgatttaatttatgcaattgctacacctgcacttcaagctgtagctgcagcaacaactgaaattccaattgttggatgtgctgtaactgattatgaaagcactaaacttgttaaaagcaatgataaaccaggaggaaatgttactggagctagtgacttaacacctgtagaagatcaatttgatttaatggaaaaaatgctgcctgatgccaaaaaagtagctattatgtattgtggtagtgaagataattctattttccaaggaaatctagctgttaaagcagccaaagaaaaaggatacgaatataaagtttataaagtgtctgattctaacgaaatccaagctgttgctagtcaaatcgtcaatgataaaaatgatgtagtttatattcctactgataatcttcttgcaacttatatgagcagtgttgaagcaatcacttcccctgctaagattccttgtatcgtaggagaagaagggatggtaaaatctggtggatttgcaacttatggaatcaactatgaaaatttaggacgtgaagctggtaaacaggcagttgcaattctaaaaggtgaaaaaactgcagcagatactccaatagctcaattaaaggctgaagattgtactttatgtattaatttaaaagtagcagaagcatgtggtcttacaattaataaagatgattatcctgatgcaacatttattgaagaataggagttaaaaaatgggattattttatacttatttaggtgccgttgatttaggtttgatctggggatttttagcactaggagtatatattacttttcgtttactagatattgcagacttaacagttgatggcagctttgctactggtggagcagtatgtgctgtttgtgttttaaacaacattcatccattattagctattttaatcgcaattattgctggttttattgctggagcgattacaggaattttacacactaaatgtaagattcctgccattctagctggtattttaacacagattggtctttattcaattaatttaagaattatgggtggccgtgctaatctaccactaactactgcaaatactttatttgctgatttatcaacagctttaaatattaataaatattatatcactcttatcgtagcgttgatatttgtaattatttttattgctgtactgtactggttttttggaactgaaatgggttcatcaatcagagctactggaaataatgaacaaatggctagatcactgggaatcaatactgatactatgaaattattaggattaatgatcagtaatggtttagtgggactatctggcgccctatatgcactatatggccaagcaactgatgttcgtgttggtactggagctatcgtaattgcattggcttcgatcgttattggagaagttgttatttctgcaaaaaaaggcggttttgcaattagattagtttcaattgttattggttctatcatttatcgtatcattgtagctttagtactacaattaggattgaatactgatgatttaaaattattaacagctattcttgttggtattgctttaacaattccaattatgctttctaaacgaaaacaagttgcaatgtataaaaaattaacaaaggagattgatgataatgcttaaattaaaacaagtaagtaaaacatttaatcttggaactgttaatgaaaaaaaggttcttcacgaaatcaatttggaattaaataaaggtgattttgttactatcattggtggaaatggtgctggtaaatcaactttattaaatatgatttctggattatatcctttagactgtgggactattacattagacggtgaaaatatttctttacagcctgaacatcaaagagctaaaaaaattggtcgcttattccaagatcctatgttaggtacagctggagatatgcagattttagaaaatctagctcttgcaaatcgccgaggaaaaccacgcggtttatcttggggagttacgaaagaagaaaaagaacaatatcgtgaacttgttaaatcattgaatctaggtttagaagatcgtttaacgacaaaaatgggcttattatccggtggtcaaagacaagcaatcacattattaatggctactttgcaaaaacctaaattactcttattagacgaacatactgctgctttagatcctgcaacgtcagcaaaagttttgaaattaacaaacgaaattattacaaaacaaaatctaacagctatgatggttactcataatatgcgcgatgccattgacgttggtaatcgattaattatgatgtataatggacgaataatttatgatgtaaaaggtgcagaaaagaaaaaactaacagtcgaagatctgcttcataaattcgaagaagctagtggtgaagaatttgctaatgaccgaatgttattaggatagaactgtttttacagttctatttttttattacaagtaatttatccttttctaaaatacaataaaaaacatcttcaatatgatcaacatgctgtttttttagctctttttttaaccaattgagatcacgatttagtaactttaaattatcttcatcaacaattccatcacaaatcaaagcatcaggcaattcaacacaacactcatctttaggaattatagataatgaaccatttgtttctagtaaagcaaattctactttagaaatactatcaatatcatttactcttaaatgatgcgaaagatcatctacagtataacgctgttctttcatcttttcttgatccaattttcccttaaaaataatatatgttggccttccttcaaaaatatctcgaagtttttttgatttcaatgtaaccatggaaactaagcgatcaactacgatcaatgtaacagttgctattacaccatgaaaaaaagtaaaatcctcattaccaactgtatcggtcataatttctgcaataattaaaaatacaacaaaatcaaaaacgtttaattgactaaattctttttttccaaaaattctaagtaaaacacttaaataaatatatatacaaagacttatcataaatacttcgaagatactcatatttcaccaatccttaaatataatattattaagataacaaggaggaaatatgaaatcatatttaaaaatatatttaaaatttgcattattcatcctaattacctttatgatcactagtcttatcttagccggtattattagttttattcatttatctaattttatttatcacacaatcatcaatcttgttgcaggaattattatggttatctggggctttatgatcgttaaaacattttctaaaaatgctatttaccatagtttattatgtggcttaatttttgcacttatagcccttatcatcaatattgatgatataaacattgttaatatcatctctagaccatttgttttaattactactgttattattttatctttatataagaaaaaattaaatgattgaaaaacacttacgatttgattaattactaatacttaaattctcattaaaaatcttcaaagtatcaaaattacactaatagtaataaaattatatttttctaatttttcattttttaaaatattaaataaaaacatgtttttttaaagtaattctcctttttagattgtaaaagataatgaggaggaaaaaatatgattcatgaaaaaactattatcgataataacaataatgttagctttagtaatgacctgttctttaaatacctgctttccagagatactttagaatctataaaactgagaaagtttatcgttaaatccgtcactcatcttgattgtcaacaaatgatcgttaaaaatccggaaatcaatcaaaatactatcctcgctaaaaacatcatcctcgatatctgtgctgttgatgaaaagggtcgaatcattgatatcgaaatgcagatggccggcaatagtaatagcgaaagtacaagatttcaattctatggggccagactgttagtagaacagatcgataccggtgaaaaatatcatcagctaagaccggtatatcaaatcatctttatcaatgaagatgatgatcgtttgatcaaagattatgcgtttcgagatgatcagggagagctggaaaaagaaaatcttaattaccgctattttatcaaaatgagatatatcgataagatcatcaaggaaaaaggaatcgcagaattaaatgatttagaaagattatgttatttgtttataaaaaatgaatacactgctataatgaaggaaagagaagaagatatagtggagatggtgataaagatgtatgacaagtttagaagcaatgaaccgatatggtcattagcgaaccagttagccttagcgaagcttagaaccgaatccttagagatggagcgcgaagaaaagacagccaaaaggatcgaagaaggaatcaaaaaaggtatcgaacaagggattgagcagggtatagctcaaggaatcaaacaaggaattgagcgaggtattgaacaaggtatcgagcagggaattgagattggacgagaagaaggagttgaaataggcaaaaaagaaactttaaaaaaagaaaaacaaagatgcatcaagatattaaaaaagcaatatcatcaagactgtcaggaatgggtagaaggcttgagtgaaaagcaattagaattaatatatgaatatatatttgaagaagatgattttgaagtatttaaacaaaggatagaaagctgataagtattattgatgggtttgtcaagtaaagcgtgtaaatatatattagtatttatacctttaataatttttcaattaatgatttgaaaatatattcaaacctagtttaaattacgattatttctttgaaattgatttcctaaaaatctggggaatgtcaagaaatttgtgtaagtaattttattaaattgtcaaagaactatagaaaatctgttaacattaatccaaaaaagaagccaaaaaacattataatcggtgtttttggcctttttatattttagttaataaaaaagaattagtttgatttaactaattcttaaattcaatattaacaattcttacatcataaggttcagctaccccaactgtaacaatttcattcaccccatgccctaaaaccgctttagctagtggtgattcatttgaaatcttaccatttaaaggatcagtttctgtaaaccctacgatttgataactttctggttcggcatctttttcagataaatctaaaatagttacagtagttccaggtttaaccacttttaaatccatctgatcttcagatataatttctgcatgctgcaacatgtaatcaatttctttgattcttgattctaagtgagcttgtttttctcttgctgcatcataatcagcattttctgataagtcaccttgagaacgtgctaattgtaattcttcaataaccttaggtctttcgacattaattaaattatctctttcttgttctaatttttctaacccactttgagttaacaatactttttcttgttccataatctcacctcgtagtctctaatatagcatatattagattaaatatctagtcctaatatttccataatttttatcacaaatcattgattttctacaaaatattaattgatatatttttccacctaaataacccttcttcccatatcatctttttctaattcaatacttacaggaatccgtaatatttccatcggatgattagcaacttcaacctcaatattatcttcattaataatcttggttactaaaataagcacattatcatgaaaaggactaaaaaactcgattttatcacctattttaaaataattgcgctgttcaataaccgctaacttattttccttatcataactaatcactcgggcacaaaattcttgagttggatgttcatcacgctgattatataactgctttgaattatcagcttggttatcaaaaaaaccagtacataaagcacgattagcagctttaagtaactcttgataatatttatcatctaaaacaaaattatcaggatcattacaataatcatctattaatttacgataagtagaaacaactgttgcaatataatgtaacgatttcattcgcccttcaattttaaatgaattaactccaatctcaattaattcaggaatatgatttattaatgccatatctttactagacatactaaaaggaatttgcccttcattaagtttttgattattttcaaaaatatcatagtaccagcgacatgattgactacatccgcctcgattagcatcacgatgtgaaaaatagtttgataacatacaacgtcctgaataatgaatgcacattgcaccatgaataaaatattcaatatcaatatctgttttatctaaaatattttttaaatcatcaaaacaaacttcacgtcctaaaacaacacggtccatcccctgtttttgataaaacttaattgctttagtatttaaagtggaaagttgtgttgaaacatgaacttctaaatttaatttcatatctttagcaattttcatgatatatggatcagctacaatgattgctctaacgccagcatcatctaaagctgctaaatattctttgattccctccaaattatcttgatgtaaaataatattacacgttacatgaattgccgcattatacttatttgcaaaactaacagcctcttttatatcttccaaagtaaaattagatgcacttgaacgaagagaaaattctttgccaccaacaaaaacagcatcagctccatatctaattgcaactttaagtttctcaagatttcccgctggcgctaataattccggtttttttattataattcgtttaccatttattattttacttacatttctcattttcttcccgctttcttacatcatcaattttataaactgtggcatcaaacataaaactatgatgaaaattaacatcactttctaaacgataaagctgtggcaataattctttgctaactttaccatatgttccattaccaatactttttaaagcatcctgatataaatttactatttctactaatttcaaatcatcaatgaacaaagattcaatatataaataatcaaaatccataaaactactcaaaatatctaaacaacatagctgttttttacttaaaatatgacagccaaatttatcttcatatatatgacagccataatctacaccactagcttgaataacaattccatcattcatcgaaacagatttattcagtttaatttctttaaaataattagataataattttcgtttagaataagccatatactcaacaccgtgaatctgtgtcattgttttcaagttactatttttagcaataataactttttcatcaagaggaatttcacgtgctaaaaaagcactatcaattcctaacatagataaataatttaacgttgcttgattagtatttaaagtatccggactataaatcatttcaaaatgataatcattttcctgacaaatctctaaaacaccaaaatcttgaaacaaaataccatctatttttaactcatgtaactttgctaaatggtccattaaagcatccagatcgtgttcttcgatcaaagcatttaccagcacccacagcttagctaaacctaactgatgttttaaacggcgtaactcttcataatcaagtgccaaagcttggcgacaagaaaaatattttgttccgacaacaaaatatttaacccctatatcaataaaatcattaataaatttatcgctatttaaatgtactactaactccattataccaccttttttcttatcacacatatcccatcaccaatatgataatactcaacatcatattggtcattattaaagatccaatctttgaaatgtttgatttttttcaccaattgtttagtattacgatttctaatattatcaatatcaaagatcatgccatgaaaatcaagattatcaacaatacagatccctttatcaactactaaaggcatatacttttcaaaaaatttttgatactgagctttagctgcatcaataaacaaacaatcatattttttcaaaacaagatcattcaactcaaaatccaaagcatcaccatgatgaataattatcttttcatctaattcattatcatttatattttttaatgcttctaaatacctttcatcattcaattcaatcgtttcaactttaaaatcagaaatattactaactaacatcatcgctgaataaccgattgcactaccaatttctaaacagttacgacaattattttctttaaaaacattgatcataaattctaatccttcacgttgcataacgggaatatttcgttcaatcgcatctttttccaactctttaaaatacttcattattaataccacttattttcctttactacttgctgatgttcaccatatgtctttgaaaaaattactgttccatcttttaaagcaaagaagaacaaatcatcagtttttttataattcagacatgaatctaaaatttcattagaaatcgtacttattggtccaattggcagaccttcatacttatatgtattatacttagaatccacttctaaatgattatatgtaactgcaacagttttaatttgatttgcataatttaccgtaacatcactacctaaacgcatatttatttctaaacgatgcataaaaactcccgcaatcttagtttgaacatctttattccctgaagcctcacattgaactactgatgctaatgataagaactgatgaacagtcacattattaccatttattttaaattctgcaattttatctttaattgcacttaaattcttatccatctgatctaacatcattttcgtaacatcctcaatcgtcgtttttttagatgttatcacataagtttctggtccaaaatatccttctaaaggaaacatgatttcatttcctaaaatacattgatctaaaaaccagtattggtcaactaatgtttgcaaatattctttatcagcccatttttccaataccttttgtgtctttgctgccaagatttgttcatcatttaaattagttgtatcaacctcaatatctaatgcttttgcgacttgactagcacattcaggaatcgtattgccgtctaaaatagtaatctttgcagtagaaatataatttttatctccttcaagaatctttaaaatcgtctttaaatccatatttttatttaaaacataaacatttgcaataaaatcatgtttatgtaattttgcataaatatcagcaaccattttattctttattaaacctgcttgatctaactgatttattactgtgcttgttgatccagaaatttcaacaacaacttcttcactttttgcagatactgctttttgtccatcaaaataaaaaaataacaaactaaaaacaataattaaaacagctataatcgtacctataataattttttgctttcttttcataatctcctccgttttttacattataagatatttttctcacttattcaacttatctgtaaatataacaaaaattgacaattctacatttagtatgtccatttttctttcaaaaaaaagagatggagatcatctctagtaatctttattaaatttagtaatacaaactggttcatttactaaataactaaaatttgtttcaaaaatcattccgccacgttcatttctaaattcgtagctttctataacgccacctttttgacaagtcactacgatccagcgatctttaaacaacactaaatcaccaggatttgcagctgtatccacaaattcttgataagtaagttctccagtttctaaatcacgattcagcagcgttaaactatcatgacctcgattcgtaacaaagattcgctcctcgttttcactaaaaatcatttgacttgcataatttttttcatcaaattcatttttaggatatgtatcgatcatttgaattaaatcaaattttagatcatgatatttataaacgcctatcgtgcttgataattcatataaaatataggcatatttaccacagttactaaacattattttctttgggccagagcctggttctaaaacaaatgaatgttcttcatcaagaaaaatttctttttccccaactttaaagagccatactttatcagttcctagatcaatcacaactaaacgtcttttatctggcgtaaaatcaataaaaacaggatttgattttgcataatcaacacttgattctttcaatttatagctaaaaattggtacaaccagttttttcttttctattttaattactatgatttctccattataataatttacagcaaataatttatctgccgtttcatgatcaccattagtgcaggcatgaatatatgtttttccatgatcactgactcgagaaactaaagctaatatatctgcagttgccgcataagaacaaattccgccatcaacatttgtacccgtcttatttttgtatgtaatacaaacaaatcgcccataattaaaactatatataggatcagaaggtgtattaaaatattttctaaataaaatttcaccactatcaatatctatttgaaaagtataaataccgcgtgtttgattattaccaaatgaattaacaaaaaaagattctgttattcttttttttccaaaaattcccaatattgccatcatttatcccctttatccattaataataaaaaagctaaatattttagctttttattattaatcacatttatttttacagcattcatgatcattatgattatgttcaccacagcacccatgatcatcttcatgacagcagccaccttcaccatgtccattacaacattcatgatcatcttgattttcagccatgaaactttgaaaaacttcttcaactaattcccattcatcagggctttcaattgggtataattttccttcatcatcataaatcgatgcaaaaacacttggttcttcagctaacgaatcatagtataaaacgtattgcttacctaattcatcattattaaaagtaaataatacttcaaactctttttcatttccttgatcgtcaattacttggattttatttgcttccattaaatttcctttctaattagcatctaaatagccctgtaatattgctaccgctgccattttatcaattactttttttctcttttttctagaaacatcagcaaaaatcaattgatcctgcgctatttttgtagttaaacgctcatcaactaaaacaacatttaaccccgccacttttttttctaacatttctttaaatttaattgaaatctcagctcttattcctaaatcaccattcatatgctttggtaatcctaacaccacagttttgatgttatttttgtcaattatatctttaatataatcagctgctttttcatattcatcttcagcaaaacgatatgtttcaacgccatgagctatcattcctaatgcatcactcatggcaataccacatgtccttgagcctaaatctaatcctaatacacgttccatcctatttctccaaatacgatttaactaattcttcgatgatttcatcacgctcgatttgttgaatgatatttctagcatttttatgactagagatatacgcagggtcattagagattaaataacctgcaatctgatgtactgcattatatcctctttcatttaaagcatctattaccgtttgaagattgctgcgaatcatctcacgacgcatatcctcagaactaaatacttttgtttttgttaaatcatgcatattattcgacctccttttaaggttacacctatatcatcattttacactaattataagtaaattaaaagaaatttttaagttcttctttaatacaaataactttttcattgattggacaaccaccttgagcaaaatccggttttccgccaccacgtcctgctactacagcatttatttttttaacaatatcgccagctttgaaaccattagcaacataatctttagtcaccccaacataatatgaacatttatcttcaaactgtgatactaaaattactattcccgaatcaattttatccctaaaatcaaaagttaactgttttgctttagcactttctaaagtttcttcgacaaataatactttgaccccattgatttcttgaatatcattaactttactagctgcatttaaagcattcaatttagcatttaaagtctctacttcttttttaacagcagctaattcttcatttaaagcactaactttatttactacttctttacgattttttaatttcaaaagattactgatagtatctattgtttccttttcttgaactaaagcttcataagcgcttttaccagtgatcgcttcaattctgcgtacgccactaccaacactttcttcagtttcaattttaaataaaccaatattagcactgttagctacgtgacagcctccacataactcttttgaaaaatcacctacagaaacaacacgcacagtatcaccatatttttcatcaaacagagccattgctccacttgataaagcttcttctttagacatgttgacgatttcgacatctattccttggaaaataacattatttactttttcttcaactgctttgatctgttcgtttgaaatcttttcaaaatgagtaaaatcaaatctcaaacgattatcatcaacatatgaaccagcttgattgatatgactaccaacaacctcttttaaagctgcctgtaataaatgcgtagctgtatgattagcaataattttattacgttttactttatcgatttctaatgttaaaacatcaccaacactaattgtcccttcttcaactttaacaaaatgtaaatgctgttgattaggagcttttaacacattgattacacttgctttacaattatcattataaattattcctgtatctgcacattgaccacccatttcagcataaaaagttgtatcatcaaaaataatttcaccataatcatctaaaacatctgttttaacaccatctttaaatattccaataactacaccgttaatatttgtcggatcatattcaaaagttgaaggcagatcaaaagccattaaatcaggtttttgactagccattgattcattatcctcacgagcaccacgagatctttcccgctgaatctttaattcttctttaaatccttcttcatcaacctttaagcctgactcttcagcgatttccaatgttaactcaaatggaaaaccatatgtatcatataatttaaaagcatctttaccactaatagtaccatcgctatttttagcaattaaactgcttaataatttttcaccatttgataacgtcttatgaaaagcttcttcttctttcttaactaaatcactaatataactaactttttctggtaaataatcatagaattctttcattacatcactaacaacagctactaaattatacataaaagcttgttcaataccaatttgtttaccatatcttacagctcttcttaaaattcttcttaatacataacctcttccagcattatcaaataatgctccatcagctaaagcaaaagtaactgtacgaatatgatcagcaatcacgcgatatgccatcttattttcacgataacttacatttgctagtttttcagcttcatgaatgatcggtaaaaagaaatcagtatcaaaattagtttctccatcctggatgatacttgtaattcgctctaagcccattcctgtatcaatatttttttgtggtaattcttgataatcttctcgcgcaattccttcttgtgaattatattgtgaaaaaacaagattccaaatttcaatataacgatcattttctaattcttcataaaataattttaatcctaaaccttcaggatcatatttttcaccacgatcataaaagatttctgaatctggtccacatggtccttcaccaatttcccagaaatttcctggggtttttaacatatgactaggatcaacacctttaacatcgacccaatagttatatgcttcatcatcatgatcatgaacagtaatatatagtttatctttttcaaaagcaaaccatttttcatctgttaatagttcccaagcaaaatcaatagcttcttttttaaaatagtcaccaattgaaaagtttcctaacatttcaaagaaagtatgatggcgtgctgttttaccaacattttcaatatcgttagtacgaattgatttttgagcattggtaatgcggggattttcaggttttatagttccatcaaaatatttttttattgctgctactccagcattgatccaaagtaatgttggatcgtcatttggaattaatgaatgacttggttcaactttatgacctttgctttcaaaaaaatccaaaaacatttttcttacttgatttccagttaattgtttcattttcttctccttatccaatataaaaagccgctcctaattctaggaacgactttgatcgcggtaccatcctagttcatgaataaatcatgccctcatttagctagtaacgcagcttacacggtaattattaattactctccaaagtagctttcctataaacatgcttagtattttcaccagccatactatctcttaaaacatctttacagtactcttctttttcaacgatttaccaaattataaactatccatatttatttttcaagtctcatcttacatctttgcttttaaattatccatcatatcttcaacacattcacactcactaaataaaatcatcagtgaagcaacagttaaaccaatcagtaatttatttcttgctaacatattctcacctcagtttagtttgtcatgattctaaaaaatcatacacacttaattctttactattttcaaaacgtttttttaaagttgttttacgacgaccatcttgataattattaagaccatgcataaatgctttagaatttcccaaaataaagagagattgtttagcacgagttattgctgtatacaatagattacgccttagcataacataataatcagataatactgccataattacgatcttaaactcatttccctgcgatttatgaatcgacatacagtatgcatgagtgatcgtattaaaattttgtgaagtatattcgacaatattaccatcaaaatcaactactaaagtatcttgaagatactcaaagttatcttttcgacagatttcaatcaaagtgccgatatcaccattaaaaacatcatcatcgggacgatttttcaattgtaggatcttatctttgattcgatattcgacacggccaactttataactttcactaaattcatctttaggattaaaaacatcctgtaaagcatcatttaatgcatcgattccggcaacaccttgatacattggaaccagcacctgaatatcattaacatcatatccttcattcaaagccttctttacgattgttttaacatttttaacaacatcataatttaaacagggaaagtaatttatatctcgatactgattaaaaatcgccatatcttctatttcatcattgataatacgatgagctaactggatgattcccgaatctttagcttgtctaaaaatttcatctaattcaatcgtttttatccccgcttcaattagatcctgtaaaacatttcctggggctacagacggtaactgatgatgatcgccaataaataatattttattgatctttcgtcccgcttcaaataacttacttaaaagcaggcagtcaaccatcgaaaactcatcaatgatcaaaacatcgatatctagaggattatttttattcattgcaaaagtattactatgtagatcccattttaataaacgatgaatcgtacaagcattgattcctgttaattccatcaaacgtttagcggctcttcctgtaggcgctactaaagcgatacgatcttctggatataaagtcgtataaacttttaataaggcttgaacgatcgttgtcttaccggttccgggaccaccagttaaaatcatcaccgatgattttaagaaataatttaatgcttctttttgttttagcgcataagttatcccttgctttttttcataattttttaaaagacgctctacttcatcttcatcaaataattcatcaggtcgattaattcgtgcttttaaatattttgcgatatttgtttcggcttcatacatctcatgataataatatcgttcatcttctttaatgatcaatccttcatcgatcaattgttctaaataatcataaaaaatcgtttcttcaagattatagatgattttcttaaacatctttatgatttcttcaagtaaacaataggtacttccagtattgaaaccatactgtttaatactatagacaatagccgccttgatccgattgggatcatctaaagttccaccagtttttaaagctagatcatctgcagtcttaaaaccgatcccatcaatatcttcaatcaattgataaggattattttgaaggatctccagggtcttttcttgataaaaagcctgaatcaaacctaaattttttaaactgatcccatggcccataaaaaactgcatcacttcttgatcataatcagcattagttaaagtatcgtaaatgatatcgcgacgcttttccgtcattccaatcacaagatcgagactatgcttatctgctttgatcttcgttaaacagtcttcacctaaactatcaacgatctgttgtgcaagttttttaccgattcctttaaacaatggacttgacaagtattttacaatttcatcattttctttagctaaaataattcgatactcgtttaatttaaactgttttccatatttaggatgaatctcataatcaccaataaatagatatttatcataatcattaaaattattcatatagccattcatcgtaattaatttatcttcctgctcaacttcaattagagctacaatataattagaagattcactataaaagcgaatcttcctaatataaccagtatattcaatcattataaatatttgatcggttcaccatctttatagacagtatcgatcgttcctcctcccaaacaaacatcaccatcataaaagactgcggcctgtcctggagtcactgcttttaccggcttatcaaaagttaaatagaccgtcttttcatcaacaaactctaattgaattggattatccatttgccgatatctaaacttagcattacagttgatcttttcagttggcttatttgatgcaatccagtttacatcagtaattaaagctcctgaagaatataaccagtctttttgatcaccctgacatatatataaaacatttttatcataatctttgccaactacaaaccaggcagctccaggtcccccgattcctaaacctttacgctgaccaatcgtataatacatgatacctgaatgatcaccgatcacatcaccagtttcgatatccaccattttccctggctgagctggaatataattttgtaagaactttttaaaatcacgctctccaataaaacaaattccggtactatcttttttatcagctactggtaattttaattcatgagcaagtctgcgtacttcctgcttatcaatttcacctagcggaaataaagaattttgcaattgttgttgatttaactgacataaaaaatagctttgatctttattattatctaatcctttaagcatgatcgaatctttaccatcctgatgaatcactcgcgcataatgtcctgttgcgatataatcagcattcaatgttttagcataatctaaaaacgctttaaatttaatatgcttattacataaaatatctggatttggcgttctccctttacgatactcatctaaaaaataagtaaaaacatgatcccagtattccttgataaaatctactcgttttattttaatatctaagcatttagcaacagctttagcatcattataatcctcttcttgaggacaaatatcattgtcattagtaggattacctaaaatatcattgttcaactggctatcccaattacgcataaaaacgccaatgacttcataaccttgtttttttaataaataagcagctactgccgaatcaacaccaccacttaatcctaatactactctttttgacattctcgtcacctcacctgcttataataacatttctataaaaaaaaagaaagaaaattaattctttcttattttagtcttgacattggcagcattgccgctccgattgccccacaatcttccaatttagttgtcaataaaggaatatgtccctgcattccaacatgaatctttgaattgaattgttcaactaatttatcatagaaataatcttttgatttcattaccccaccaccgataataaaacagtgagggtctacagtatgagcaatatttgcaaataaagtagctaactgagatatgcattcttcaacgatgctttgagcctttaaatcaccttcatcagctaatctaaaaacatcgccagcatgatttactatatcttcacctaataattctttaccttttcttgtaattgccgttccacttgcctcaccttcaacagcacctggattcaaagcaccaaatttatagccattatttttaacgataatattaccgatttctccagcgtgtccacggccaccagatactaatttaccatcaacgataaaagctccaccaattcctgtagaaaccgtcacataataacaagttggataattttttccagctcctaataaggcttcggctaaccctgccacattagcatcattatcgataaatactggtaaattaaaacgatcagccagtttatcacaaattggataattttcaaatcccggtaaattagtagccatgatcatcgctccttttaccgtatcaactggccctggtacaccaattccaattccactgacacctttcatcccaccacaaacagtagtatccaaactttcaatttgccgaatgattttagcacacacgtaatctggaccattgtctctttcagtattatcttttacttcactgtatgttgtcccattttcatcaactagtaaagtacggacatttgtcccacctaaatcaattccaataaaatatctcatcttattcctcctgtaagcatataaataattatacaataaagctgctagtattaaaagatatctagaataaacttttttctatttttttaaacagctctggcacaggacaaatcatttccttatcctgtaaataatccaataccccaaatgttttgacaaacctgatcttataagcatgcaaaagctgattattcaatccaaaactttttttaattattttatttaattcaaaatctccatatttacggtcaccaataacaggatgatcgatactagcaagatgaactctaatttgatgcattcgtcccgttactaaagttacttctaccaagctataactatcattacttttcaatggttttaccagcgtttccatcgttaaagctccggaatgatctttattcactaattttacctgcgcctgatcttcaagttttatcatgtagttttttaaactacgtttttgatttaattttcctttacaaatcgtcaaataacttttttcaatacaatgtctttgtttgatcatttcatttaaacattgtaaagccgctaaagttttaccaaagataacgattccactcgtattacgatctaaacgatgaactggtcctggcataaaagtattttcccgccctagatccaactcattctttttagctaaatagcttaatacttgattagtcaaagtattaacactttcattaatatcttcatgaactaataaacctgtcggtttataaacaatcaaaacatgtttatcctcataaagtactttaaatgtcttttcgacatcatagatacttttagcagctgtgaattcctgaaatttatcttcatataaaaacatctctacaacatcattattttttaaaatatatttttcatcaactttttttccattcaccttaatatcttttttacgaaacattttataaataaaattagctggtgcattcactaaaagtttcttcaaatatttatcaattctttgattagcatcattttcattaatctttatctttttcatatttatcaccatagatcattataacaaatttcccaaataattccgcaactattttaatgaaaccctttacatttttaaatctgaatgctataatattattgtcaagtgaagatgattcactttacataccccctattatcacccttacgtgaaataatataaaaaagtatgcacccccgcatacttttttgttataattttatttgaggtgaaactaatggaaaagaaaatagctagtgaattgatttatgatggcaaaatcattaaagtttataaagatgaagtaatttgtgaaaatggtaatgaagctactcgagaagttgtcagacatcatggtggtgtgggcgttttagcagtcgttgaaaataaaattctgcttgttaaacaatatcgctaccctaatgccacagatactttagaaattcctgctggtaaattagaattaaatgaaaatacagaaatttgtgctttgcgtgaattagaagaagaaactggttacagtgctaaaagtatcgataaaattgcaaaatttttaccaactcctggttatagtgatgaatggttatatatctatgaagctaaagatgtttttaaagttgaaaatcctcgtgcttgtgatgaggatgaagaaattgaagttattgccatggatatcgatgaagcatatcaaaaagttgttagtggtgaaatctttgattctaaaacaatgatcgcgattatgcacgcctatatcaacaaaagcaaatcataagatttgctttttaaatacaaaaaaagttctgttgaacagaactaatcatctaattggcggtctggacgggactcgaacccgcgacctccgccgtgacagggcggcattctaaccaactgaactaccagaccaattgaatggcggagacagagggatttgaaccctcgcgccagtttcccgacctacacccttagcaggggcgcctcttcagcctcttgagtatgtctccgtttcctcgactgcctacttataatatcatgtttagacttatattgcaatatattttttgattttttattaaaatcattattatcaattcatgaaatctctaaattatattgatttaatcagatattatcgttttatttctctacgtacaacataataattatttttatcaatatataaaatcatatatgtcagcggtaatgaaaaccgttttctgccacaactgccagggttaagataataagtgttatcgatcttttgttctaaatagcggtgagaatgtccaaaaatataaaaatcgacattttgaacatccttcttttgatgcgttaaataaaatttatgacctgctatctcacaattaagctcttcaggcaaatcaaatttatcattattcccctttaccgctataattggggcaattttttgtaattgttgataaatttcttctttaacaaaatcaccagcatgaaaaatcaaatcacaagtatttaattctttaatgacctcatctcttaaaacatcgtgagtatcagaaataatcgcaatctttttcattttttcaccttctatcaaaaattaatcactagatattttccaatcttgagctttttgttgggcttcaaccatggcagcataccagcccttttgttgtaaaagatcctggtgtcttccactttcaataatgacgccatcatctaaaacaataatattatcggcattgatgatcgtattgagacgatgggcaataactaaaaccgttttatttttcattaatttcttaaaagctgcctgtatttcaaattcattatcggcatcaagatttgaagttgtttcatccaataaaataattggcgcatcttttagtaaagctcgggcaattgaaattctttgtttctgacctccagataaagtagaaccaccctctgcgaggatcgtatcatatccatgctccatttctttaataaattcatgacaattagcagcttttgcagcagcaataacagcttctttagtcgcattcaaattacctaaacatatattattaaacactgtatcatttaataaatatacatcctgaaaaacaattgatatatatttggttaaagtatctggggcaatttcttttatattttctccaccaatcgtgatcattcccttttgcacatcccaaaaatgagctatcaaacttgctattgttgtttttccagaaccagacggaccaatcaaagcagtcgttgttccttgtctagcaagaaatgaaacatcctgcagtacttttagacgatctgaatattgaaaaaatacatgtgaaaatttaatatcataattcttgaaacaaacagtatcctttgtataaggtaatggtttttcatgtaatatcaacaaaatattttctgatgcttttaaaatcgcacgaacttgtggatataacgagcttaatacactcattatattagaaattgaaactgataataaaataataatcaaaaaatcaactctgcttattattccttttgaaaataaatacacgcctaacattaaagttatcggaatgataaaagaagtaatagtagaaaatcctaatgctaacggtaagagggaaacttcagctttaatcgatgccgcttttaaattttgtaatgcttgatttaatcttttaaaatgactcccaatcagattatataagcgaaatgttttcattcctgttacatattcaatgatctgggctataacatcttgatttgctctttttaattttacagaattttttgctgaaatctttcccgatataataagcaaaggcattgctataatgactaatatcattaaaacaagaccaaattgccaatttatcaaaaaagcaactattatagaaataatcgtaaaagaaataactttaactagatcacataaacaatgtgtgatgatcgtattaaaatcactgacatcagtaattaaaacttctgttaattttccaatactattgttatcaaaatagcccaaatttaagcggcgtaaatgatttgctatttgcaatcttagatgataagttatttttgaacccgtacactgagcttttgtaaaactgattgcttgtattatacaccgtacaacaaaaactataattaaaacagtagtatataataaaagtttttgataagtaaatgttttatttaatagatccagtaacaaaaacagcataattccatacatatatgaatttaataaagaatcaatgatcgataaaacaactggtaaaataagttttttactttctttacctgacagttctttaatccagcaaatcactttgatcatttaaaatcacctcttttgcaataaatatcccacatttttttatatctttcatcttgctgtaacaaagtgctatgagtccctttttctttcaatcgtccattttcaaagacgcagatctgatcagcttctactatcgtatgtagacgatgagctatcatgatcgttgtttttccttttaatagcgtttccaaagccaactgtattttatgttcattttcgagatctgtaaaactggttgcttcatcaaaaataataataggtgaattttttaaaatagctctagcaatgcatatgcgctgtttttgtcctcccgacatctttattcccgtttctcctgttttggtttggtatccatgcggtaaagttaaaataaaatcatgtatttgtgcagctttagcagccttttccacttcttcttgagaacagttttttttgccaattgcaatattttggtaaatcgtatcatttaacataaaagtttcttgaaatacaaaagaaataagctccatcagattatcagtggcaatatcttttatatcaattccatcaattttaatagctccctcgacaacatcaaagaaacggggaatcaactgagctgctgttgtttttcccgcccctgatgctcccaccaaagctgtaaaactacctttttctatctctaaatcaacattttttaaaaccatctttttattataagcaaaacttacattttcaaattgaattgcatgtgttttggtaacctctatatgctgatgctttgatcttatttccggaatatccattactcgcttgatttctgccagccccgaagaaatttgactaaaaatctgggcaaaattcaataaattattatatgaagataaaaaaacaatactcataataatgaaaaaaatatattgttctaaccccaaatttccctttaaatacatgtatcctcctattggcaaaacaaaaaagatccccgattcaatcacgaccttcatcacggcacttagcggagctaagatcttgctgaatcttatccataaatcattataatcataaatagcatgagcatagtttttatacgaatctgctgttaaattataagctttcataactgacatgccactaatatactgcatgattccagaattacaatttcctaaaatagtcgaaaagtctttcatgatcggtttagcaatatgcatctccagcatttgaataattaaagtaattaaaataggcacgactaatattaaggtcataagataatttacataaaacaaataaataaaaacaataataggaaccacaacagctactgttatatcaggaatttgatgtgcaaaaaaattttctaatcgttcaacatcctccactaatatttttttgatttcaccagtattatgatcagtaaaaaagcctaattccacctttccaagatgtttacacatttttttccttacaacataaagcagattataagcaccaatatgtgtgattgccatcgaaaatgccaaaaatacaaattttaaaacaattgctaaagcagctatagatccatatagcaaaacactttttatttcaccattatcatcagataaaaataagatcgttttaaaaatcatgatatacggtacaaaagtcatcagtcctgatatgatgcttaaaatgattgcgatatacagtgaaattttctgattattatcagttaattgaaaaagatattttgatttaacacggtcttgttctttttccatctttacctccaataagttagaactatctaacatcatttttttaaataaatgtcacactagtgacatctttaaatcaatgatataatatcaacataaaaaattcaataaaacccaaacaagtgctacatatatcaaattttggggcatgaaaggagtaataaaacaatgacaataataaatatccaaaatctaagccgttgccaacaatgctttataaaagctttgttggaactattagagaaaaaaagttttgatacgataacaatcaaagaacttgcaaaaaaagctgattacgaccgaaaaacattctatcgacactttacaaaaaaagaagatattttgaaattatactgtggtcatattttacaagaaatgtcaacttcaataaaaaacagaggtcctttgacttttaaaacatatattctttcatattttgaattttgggataaacacatcgacttcttatatcttttagaaaaaaatcatctgctgcactttttaggagacctccaagatgatcttatatatcaacacgttggaaaaaacattcaacctgaaattcctgaaactctagaagctgctttagattattcaaaatatgcttactattttacccaaggtggtctttggaatatccttattcactggatcaaagagaattcacgcaatgtaccagaacaattaactgctcatattcttgattatctcaaagaggctcaaaactatattgaataaaaatttgatgaggccttaaattttgcttttaataaaaaggtgttcactaaaaacacccttttattagatagcccaattggcactatctttttgcagataaaataatttatgatatagaccctgttgcattaataattgtttatgggttccctgttcaacgatttttccattatttaaaacaaatatctgatctgcttcagtaatcgtttttaatctatgagcaatcattattaccgtttttccacggactaatttagaaattgctttttggatcaaaacttcattttcaggatccagacttgcagtagcttcatccaataaaataatcggagcatcttttaaaatagctctagcaatagaaagccgctgtcgctgtcctcccgataatgttgccccattttctcctaaaacagtatcatatccccctggtaactgttcaatatattcatgaatcattgctgcttttgctgcagcaatcacttcttcttttgaggccttcatattgccaatatgaatattattatatatcgtatcattaaacaaaattacgtcttgaaagacaaatgacatatactgcatcaaactatcaggctgaatttctttaatatttttattaccgatcgtaatcatccctttatcaacatcaaaaaatcgtgaaatcaatttaactaaagtactttttccgctaccagaaggaccaacaaaagcaataactgagccttgaggaatctgcatactaacatcatcaataacgagattcttttgataagcaaaagaaatatgatcgatattaatattaaaattatcgactgtcgccttttttccggccattggtacagctgttaagacagtacgcatacgttttgtaactgtttctaaatgcaataacgttgaaagctgtcccatcaatgcaatgattggtccataaattctagtagaaatcattaaaaacatcaataaatttataaactctattttaccttcacttaaaagcgaaacccctataaaaatcgatattcctagtccagcctgtaaaataatattagcacttgaaataaacatccccactatcaattcaactttgattgctatttttttcattgcaagtaaggcttgatttaaagcttgaaattgctgtcccgctaaattattcgctttaataactttgattccttcaagatattcttgaacctgattagaagcttctaaatttgttgctacctgtttttcaaataaacttctttgtttttttcgacttaataaaataaccaaaaaagaaactggtagtgtactaaaaactgctaaagccattcgccaatcgaaaaatgacatcccaatacaagtgatcgtcatcgacactacattagcaatgagcgggggcagcgtactgctaagcattgattccatacttcgacaatcagccatcatattagttgttaattctgaaagatctttagtattaaaaaaactcattggcagtttttcaagctgtttagccagccgaactcttatatttttagcttctagataagaaacaagatatgtctttttataatcattttttgccgccagaaaaacgattacagcaaaaacaattcccattacaaacattagccataatttagtttggtttaaaggttttccattaagaggatttaatatttcaacaaaaatacctactgcgatcataacgggtaataacatcgtgagattagttattgtacaagcaataatagctttctttaaatcttgataacctttttcgcttaataataaatatttctttaaccttttcacattaattccgcctttctatatactttccattgcttcgcttcagtataatcatgccacatcgcagcataacggccattgtttttaagcaattcatcatgccttcctttttcaattaaacgtccctgttctaagacaatgatttgatcggcatattgaactgttgaaaggcgatgagcaatcattataactgttttattcttcattagctgtctaagcgctttttgaatcaaatattcgttttcaatatcacaaaatgaactcgcttcatccaatactaatataggagcatttttgatcattgctcgagcaatcgtgattcgttgtttttctcctccagaaagatatgttcctgccactccgatcaaagtatcgtagccctgtggcaatttcataataaaatcatgacattgtgctaattttgcaactctaataatttcttcatcagtagcatctggtttaccgattctaatattttcttttatcgatattttaaataaaaatgtatcttgaaaaacaaaactgatcgtctccatcaacgctgctgttttaagatctctaatatcaacatcaccaattttaatatttcctgcatccacatcataaaaacgacaaatcaaattagcaatcgtactctttccaccaccactagggccaacaattgccgtaatttttccttgaggaatcttaaaactgacattatccaatgctttgatatcctcttttttatcatatgcaaaacttacatgatccaatattatcgcggtatctttgattgacgatgaatgaagcgcttctttattttcaggaatattcaaaatttcatccattctagctacgtcaccattaattttcataaatgattctgaaatatacatgatcttatttagaactcctgcaatcgaaggaacgaaaattaaataaaaaataaatgttgttacaaaggcaggataatttgtcgtatgtttcgctaaatagatacctaaaggaattaaaaataaataaatattattaatgatcgtcgtaaatgctggcatccagtttttccagcccattgaaaaagcaattgcaaactgcgtatatctttcaaatgctgcatctaactttttaaaaaatccgccaccttgattaaatgctttaataacactcattccccgaatgtattctaccgatgcactactcatgtcttctaaagccgtttgataattctgcatgtttttttttcgcttctttcccaccataaccaagaaattgtgttaaaactgccaaaacgatcccaagcattgaaactagtccataacgccaatcgattgccaataaaatgatcatcataacaaccacagctgtaaatgaagcaactagatcaggtaattgatgagcaataaatccttctatactttcaatattttcatccataatttttcgcattcgaccactgccaattaaataatgataacctaaaggaatttttgtcagatgttttgcaaagattatttttaattcatagagtgttccaaatgcagctaaatgagaacatagtaacgctaaaaaataaattaggatatttgcaaagataccagctatagcaaaccaggcataagacatgatcaccttgacatccaataaagaaaaatccggataaatttgaataatttctctaatgatcaaataaattgctaaataggaaacaaaagaagctattgctgctaaagaagataaaatcattgatccgattactaatccttttttatctgcagctagttctaaacatcttgataagccctttttgggtttcaatttttcttcattcatacattttctcctttcaaaaaaacgcaagttagctaaaactaacttgcgttaattataaaaatttattctcttttcttctaccctgatacgtctactatccttataaaatagcccaaaaagtcattttctttttcgatattccttgggtaagattccataaactgcagtaaaggctgctgaaaatttactcgggtttgcataacctaatgaaagcgcaatatcgctaatatttttatctgtctctttcaactgctttgcagcaatattcattttatatttttttaaataattatacggtgtttcaccataaatttgtttaaaaatcattttaaaaactgtcatacttatagaattttcattaattaactgcactaatgaaattctattttccagatcctcgatcattcgatcatgaatctttttgactatttgtattttgcctttatcaaaatactgaaaactacaaccatgattttgacaaagctgttcaagataataacaaatttctaatgccttgattttataataatttaaattatgaatatcgattccttgataaatatcgataaataattgtcgcatactattgctagctttagataaataccagtttttatctaaatcaagatgtttgcctaaatgtttaatatctaacgataattcaaaaacagcatcaacaaatgactgatctaaatgatcttgctcaattactaaggaaactgttttacagctgtttaaaggaaaagatgttgaaatcggaagatatttagagctgcagatactaaaatatccttcaggaatataaacgatctgatgattagcaaattcacactcataacgtccttctaatgtataagtaagacataaaacatcatgatcataagtttgcgtaaaaataagatcatcggtatcaacatcgactatcacgatttgcatccctttacaaatcaaaaaataataaacgtctcctttacccatacatccataatcaattttaagataatctttttcaatttttgttataaaggcttgtttactaaaccattctttatgatatatatctttcatatcagtacctcgattagctttaactaactttagtttatcattttaccctcacatcgacaagcctctttatcctatcattcatcatgatttatatattaatattacgataacaataaatcttatatctattttacaaaaattttctactaaataagcagcttgaaactatcaagctgcttatcactttattattgattaaaattcatatggtggattaccactgaaatcagcaataacaccatgcagatctgctaaataaaagacttcaaatgttggattatcaggtgtctgataattctctttaacgatgggattttctaaagctgcctttttaatttctaaattattttcaaatacagctttcccattgattctaagccatgcaaattctggtgatgaaatacaaatttcaatataaggattttcttgcatatctttataaacatctttttgatttcctgttgtaaaccataatttcccttctttttcaaaactaaacataaaaggtcggcattttgctttgccatctcttcctactgtagctaaatattgtactgggttattagttaaaaattctacaactttatccatactatttcctccttgttgtaactttttttattacaataaaaaatatatcacgcctttattgtaatgccaatcattacaaccgttttttttaaatatataataaatgcaattaatattaaaggtaatctaattttttagattacctttaattatttcgttcatttgcaatacattttttagtatcttcaataacatcttttaaagtaattgacgctaattctctttccatcgcattttgtactcttaaaagcttatcatctaatacatcatgaatgtttcttcctacttcacattcttgattaggattttcatgaaaatgaaataattcaccatttccaatacaatcaactgccttatatatatctaaaaatgtaatttcatctaatggctttgcaatagaagccccgccactgccccttacaacatttactaactttgccgtttttagctgtcctaatatttttctaataatgacaggattaacatttgtgcttaacgctaaaaaatcacttgttatctttctatctttagcgaatgtatcaatacatgcaaatatatgtattgcaagagtaaatctactagaaatctgcatatttccctccaacctatttatcttttattcaaaatatattttagtcttctattattgtcatgtcaattattacaataataaaaacttaagctgtttttattttttcaaatctcgataaataccggcttgatcaaaaataaaaattcaatcggctcttgcaagcgttacaagtcaatgtattatactttcagctttcatcaacattattaactatttttatcaactaataaaaatgatgaaataaaattcatcattcttctctcttttttaaaatattaacttaaaccaaaatcactttttattatgattgatttcataacgtaaccatataccaccatgagtcagaacttcgacattctttaatttaaaaccaattggattattttgcgtcaatccagctttagtttcaaataaagtcggtgctgtagccgaaccatcagctgctggggcaataacaatacttaattcatcacataatcctgcctgaataaatgaccagttaagtacaccaccaccgcctaacattaaagttttaatttgaaattttcgatataatttatccagtagctgttcataatctaattggtcttttcccgcaatgatatatgaaatatttaatttttgtaacattgctttataggaattacttgctttttggcttaatacttcaataatatgggctgaagtatcctgataagttagagtattctcttgccatcctaatttacctgataaatcaatagaaacataatacatctgataattgccagttgcaataaaatctccctctggtactaacggagcatttttgtctaatagcggttttttgtataatgtaaaattatcatctgttgttattcttcctgacagccagccttgatgtttataataagcatttttaccaaatgcaatatcatagaatttatcactcggttcatcacactcttgaagattcatataatttcccatgatttttccatcgagtgaagtcaacatatgacaaaatatataaggtcgcttcatattatttttctcttatatcaaatttattttaaacgctgatattctgcttcgcttactggttcacaccattcattagatgcaccttctgccggaacttcaattgcaatatgggaaaaccagctgtctttagcagcaccatgccaatgttttacttctgtgggaatacttacaacatcgccaggatgaagttcaattgcttctttaccccactcttgataatatcctctaccatctacacaaagtaggatttgtgcccctttatgatgaatatgccaattattacgacagcctggttcaaatgttacattagcaacccccacgccttgattattagccagcagtgctaaataactttggcctacaaaatattttgcataagcatcatttttttcaccaattgcaaataacggtttgaattcttccatttttatctacctccacatatttttaatctatcatcagatatcttcaatcaacaaaaaatgcagatatcctttaacatctacattctaacgttcttctattattatgtctaatacttatttttaatgatttatcattcattaattgcatgataaacttcatcaataaatttagtaatcagcggtgataaagtttgatgctttttccaaacaaaaactgtacccgtcaataattcaggataaaaaggaataaatttgattttatcatgacactgattagaaaaagccccttcaatcgtaatagcactgccaattccttgagtgatcagtggaattatattcgataaaaaattataagttgcaataaaatggagtttttcataatcacttttaaaccagcttgctatttcattttgaacaagcgaacgcttagtatttaataacgggatatttattagatctttagctgttacagatgctttattagctaaatgattatccttagaaacaacgattccccagcgttctttttgtggtaatctaatatattcgtatctttctaaatctactggttccaaaagaattcctacatctataataccctgatctaacttttctttaactaaatctgcgtttccagtataaaaatcgtaagttacttcaggatatttattagaaaactttttaataatatctggtaaaaataaatgggtatacaaacattcagccattcccagcataatttcaccagtcagattatcattatcgctaataagttctttttctgttttttcaatgagatcaatgatttcttcagctcttctttttaacagaactcctgcttcggtcaactcgatcttcctttttcctcttatcaataattgttttccaactgtttgctctaactgcattaattgacggctcaatgctggctgtcctagatgcaggcgtttggctgctcgagtaatattttcttctcttgctaccattaaaaaataataaagcgttcttaattccattttatttctgctccttttcatgatcataaatattatatcacaatcaggataacaaacttttatcttaaatactattatttaagtgaatattctatcttcaataaaatgtatcttaaaataaaatttcaacaaacttcataattcccattttacatccaagctttaaaataaaacgaatcatcaaaggaatttcttgagccttttgaatatcatcaggcagcttggcatcgatctgaatatttttaaataacgggctccattttaaaaacatcgtttcatcatctacagcaaaatacatcatcgcccctttatttccgttcttctctactaatttattagatttttttaccccataggaactctcacaatcaaaataaataccgccctgaggaaaatgttttgctagtgcaatcattaaatctttgatcttttctagttgaaaataataaagtaaacctccacaaataatataaactccctgctccttctcgatcttttccatccaagtaaaatcaaaagcatcataagcaagattactttcacgttcctggcaggaaatcaattgatttcgaatcgctattacatctggtaagtcaatattgatccaatgacatgatccattatcaacacttccaaatcctgtagctaatccacatcctaaatcaacgatcgtagcattaggatatttttttaaatatgctttaactctatcgcacaacattcgctgccgaatcgcccatgtcgtaatttgaaattcctttagatttaatgattcgaaatcataatcaatctgatctattatttttaatgaaattggatcattaaaaatatggggatattttttggcacaatatgctcttccatacaaaggtaaaagcaaagtttcttgaactgtatcttttttaattatcattttttcactcatcacaatactcctatcatctagttagcttatactaactatcttatcatatctatttttttctttcaatcatcaaaaataagactatatttttcttttctatccatactatagtgaggtgaaaccatgcaatatcaaaatctaaaccatttaattcaatcaagcacaagttctagaaattactttctttccttaccagtagaaagacagatccagctgcatcagttaaatgacaatatccattcattacaacaattacatttatatgccaatatactaaaaaatgagcttaaatagctcatttttagtcttcttgaagatgttccaaaccttgattgataatcgttctaacatgttcatcagcaagcgaataaaacattgattttccttctcgtctattttttactagtttattttgtttaagaatccgcaactgatgtgatattgccgattgcgtcatgttaagcgctgctgctaaatcacacacacatacttcagcttcaaacaaaacaaataagatcctaattctagttgaatcgccaaaaattttatacagctcagccaaatcatataactcttcttctggcggcatcttttcttcgactatctttaataaatcttcatgaacttcaactgtatcacagcattctactttttgactactcacaatattcctcactttctataaatgactgacccgtaaagcccgaatagcatttaaaactgctaataccataactccaacatcagcaaaaattgcaatccacatattagcaataccaatagcgcctaaaatcaaacaaattactttaacgccgattgcaaaataaatattttcataaacgattcgaatacattttttcgatatttttattgctttagcaatttttaaaggatcatcatccattaaaacaacatcagctgcttctattgccgcatcacttcctaaagcacccatagcaattccaatatctgctcttgataaaactggagcatcattgataccatcaccaacgaaagcaactttttctttatttcctttattttgcaatatttcctctactttgtcaactttatcagatggtaataaatcactgtatactgcatctattttcaattcttcggctacttgatcagcaacactttttatatcaccagttaacatgatcgtttttttaataccaatttttttcaaagcttgaattgcttctttagcatgcggtttcattaaatcagaaattaaaatatgaccagcatattcattattgatagctacatgaacaacggttccaacactatgacattgttgacatgagatatttaattttttcattaatttaatatttccaacagcaacatcttgaccatcaactttagcaatgattccatgaccactgatttcctgaacatctaaaacacgatgctgatcaatttctttaccgtatgctttttgtaaacttttactaattggatgggttgaataactttctgctaaagccgcatattccaataatttatctttatcgatactggcatgatgaattcctgttacttcaaacacaccttgtgtcattgttcccgttttatcaaagacaacatatttcgtttgggctagcgtctctaaataatttgatcccttaactaaaaccccttcatgactagcaccaccaattcccgcaaaaaagcttaatggaatactaatgactaaagcacaaggacagctaataactaaaaacgttaatgctcttgagatccattcaccccaattcgcatcaatatttaaaaataatagggaaataactggtggtaaaaaagctaaagccacagcaccataacaaacggccggcgtgtaatatttagcgaatttagaaataaaattttctgatcttgatttcttagagctggcattttcaactagatctaatatcttagatactgttgattcaccaaactcttttgttgttttgatctttattagaccgtttaaattaatacagccactcattacttcatcatttatactaacttcacgtggtaaactttctcctgtaagcgcactagtatttaaagtagtttttccctcaatgatgattccatcaagaggtattttttcacctggttttacaacgatgatgcttccaatttctacttcatcaggatccactttttcaacttctccagattcattttcaatgtttgcatagtcgggtctaatatccattaaatcactgatattgcgacggcttttaccaacagcataactttgaaacaactctccaatctggtaaaagagcatgactgcaactccttctttatattcacctagagcaattgcccctactgttgcaactgccattaagaaattttcatcaaagacctgacgatttaaaattcctttgattgccttttttaaaatatcatatccgataaccaaataaggtatcatatataatccaaattctaaatatccttcaacatcaataaattctaaagcgataatacagatcaatgcaacaataattctttgcaaaacctttttttgtttcttattcatattcgtccctccattaaaaaacgctacagtcatgcagcgtttgaaccattataagaaaatttcacaatcatcttcaacaattttacagtttttaataacatcctgcataacagcttttacatctgcaccatcttcaaattcaactgtcatttttaaagtcataaagttgacaacggcatctttgactccagctgttttcttagtagcttcttccattttattagcgcagttggcgcaatctacatcaatcttataagtttttttcattttttatatctcctttattattcatttgaacaattgttcatttgttaattttattttaccacttatattgctgatgtcaagataaatactcaatatttatctaaaataaaaatgatgaagatcaattcatcatttttaaaaaacttttgccataatatcaaaaactgactcaccacaagatattttatttttaattgttcttgtacaagaatcaaaacgtttaaaagttttgatgttatttttcacatgactataaactttccaatgtcccgcatatcgataatgatctttatcattaataaacccgatcacatcacaaagaggatatcctagaaaaataccaatttcatgaggaaaatcatcgtctaataaacgcattttcaaatgttctatagcttttaaagcactatcacagggatattgatactgctttaaaaaactctgaatcggaaaatgagttaaagtatgataaagtttatcattttgatacacataaatcaaaaaactagtttgatattcttttaaaatacagatctgcaaaccatactgacgaaacttttgattaaaatattgcaaacattcatgacaattagggaaatcttttttcgtgattcgaaaaagactagctgtttttagattagctaaagttggcgcactataaagcgctaacttttcttgaaaaatatcaccattagtaggcattattaaagtttattaataatctctgtcatttttacaatatcttcatcagttccttcattctctaccttatataaacatgggacttgatattgctcgctgatcgtatctccagcttgacaataagcctcaccataaccaagatcaccgctgacaatgaccccttttaacaaactaccattatcatttaaaaaatcttctacttctgcaggtacatcaccataaccatcagtataagtgaaaagaataaaatcttgatcacagctttcacttccggtttcgatttttaaagaatcacttaatcctaatctttcaacgatcgattcaacattacctgttcttgatgcatatacaaatttcataacttcctccttggttagtttagactaactaatattttattttataagttagccttagctaacttatattaaaagtatcatgtttatctaaaaaagtcaagaatatcattaataaaatttcttattgtgtattgtaaaatgaaactggaattaaggtaatgtaatgattggctagccaatcattacatttcgccgccaactccctctagtctcaatttttaattttttacatgaaaaatgttcatagaagtcgtattattttagtcgaccaaaacctaataaaggagactctctatgaacacttatactatatcacaaaaatctaaaaataaacaccttcagttttttcattatgaatttattgttaatgaacttattcgttttaacgctctgcattctggtcataagcgtaatatcggtaaaactcaattcattcattatttggctgtttctgttggtacttctgtctctaatgtctattctatcattaaggatgccactatcactgttagagatacctatcttaatgaacgtactgaactttctgctttggctgcctttgaaaaaagatctaagatccataagacccctaacaattctaaacttcataaggctcatgattttatcactctcgttgaaaatgaaatgaaatcaaatagactttcctctgttgatgagactatcaattatcttcgccttcatgaaaaagataaaattaaaaatatggtaactgtttctactaagactttctataattacatacacgaaggaaaagtttcgataaaaccaattgatctgcctagaatgctaagaagaaagacgaaaaagaactggaaaacttatatccctaaaagacagaagggaacttctatcatggaaagacctgaaagcgttgatacaagagaggaatttggtcactgggaaggtgatcttgtcactggtccaagagatggacaaaatggtgcctatttgaccctgattgaaagaaaaacaagattttattatatgattcctattacatcaaaatcttctaaaaaagtttatatgcagatcaataagcttcataaattttatggtgacgattttaagaaaatattcagatccattacattcgataatggaaatgaatttgccagatggaaggatatggaaaagaaaccaggatcaaaagaacagcgtacaaagatttattttgggagaccatatcattcatgtgatagggcatcaaatgaaaactgcaatggacttataagatattttataaagataatatgaagtgacctcctaagttgtcaaaaagtggattacgattcataataagattagtaaaaaaacaaaattatgaaagtcgataccataacgacaataggaggtcactatgaaaagtataatttatattgggatggatgtccataaaaatacgtacagtttatgtggaatcaattcatcaacaggagaagttattgcacagacaaaatgtgctgctgaagtaaagaatattcttaaatttattaagtcagctaaagaaagaatgagtgaagaaaatgaggtggatattttaacaggatatgaagctggatgtttaggattttccttatatcatgaacttgcataccatgatattccatgtgttatattagcaccatcaacaatgcatggatcagtcaaaaataaaaaagtaaaaaatgataagatggatgcctttaatattgccactaatcttatgcacgattcatacaaagctgttcatgtaccaacagaacatgacaatgaaatcaaggaatatataggtctaagagaagatgtcatccagtcaagaaagagaatcaaacagcagatcagtgcattggtattgagacgaggattaagatatgaggggaaaagcaactggacagtggcccatatcaaatggcttgaaacgatagaattgccagtaatcgtaagagaaacattaaatgaatatttaaaagtctatgattatttaaatgaacgtattgaaaaatatgatgaaaggatagaagagttttcaaaagaagaggaatataaggaaccggtttctaaaatttcctgtttcaaaggaatagatacattatcagcaatgaagatacatgtcacagtgagtgattttcagcgatttccaacagcaaaggcatttatggcgaatctgggaatgcttccaggagagaattcgagcgcggagaaatacagcaatacaccaatcaccaagatggggaatgcgatggttagaaagacactggtagaatgtacacaggcattagtaagaggaacagttggaaagaaatcaaaagcgttgaaaaaaagacaaaaaggacaggaggatgaaatcgtagcatatgcagataaggcagtagaaagattacaaaaaagatttagaaggatggtattaagagggaaaccatataatgtagctatcatggcagtggcaagggaactagcaggatttatatggggaatggaaacaggaagaatatagaagatgtaaaaagatgttttctatacaattatgaaaatttaaagaaaaaataagaaatggaggacaaaaatcgagaaaaaaagaacacaaaatcaatggcatagaaaagcctcaaaaaaggagaagcaggtttagttatctacggtcctttctttgtggcataaataagatataaaagaagtcgcgatctggaatatcataaattatagatgattcacgtatatagatagttagaacttatttgacgaaccattaaccttggagtagccaatctccgtataacagagtggttaactgtcgataaatctagtattttggggcttttgtatgccattgatgataaaattaaataattttattatgaatgtgtaattttcacttgacaaaggtcacttcataacagaaaggaactcattgcatttcctaaatatatggatattgctccttctggtattatatcctcttcgggcttgttaaaatttctatatccctgattagaatcagtgacaatagtaccatctggggctatcagcaacgtaccattcaatggggattgcttttccccctttttatgaacagaaattgatctaatactttctattttcctagaagtaaatactctgctcggtaaatatactgttttatagtttttaataaatccattttctaaatgtactatgtaataatggattggatgatagaaacaaatcattaagatatttccgtaatcgcttaattcatatttttgatcaagataaatagtgtcatgattaaaccagtgtaataatctcaattcatcattatttaaattccaaattataattccttctttatcaaatactttgtctatcacacccttctgaattagaaaaacaacatatggtccatattctgttaaataaactttctttataacaatttgctgatttaaaatatcagggattattatttcactaacttgagaagtgctatgttcatcgatgttatgtaaacaatagcgaattccttttaagtccatctcatattgaatttccattaaaagatgatttgcctcatttgaaaacagtatattgtctccttgaaatacccctatttgctcgactttattaataacagaattccatattttcaatatattgcgattgacactaaaccattgtttccccgattttgtgagctcaaatattttttgttccgggaataaatatttacacggtctttcaagcactcgctggttttcaatatcccatttctgataaacaccatcactgcgccttacatataaaatattatcaatattgaacattttttggtcaacacgataacctactgctaatctatgaacagtgaaatcatctagtgaaattgtatcaatggatccatcaaatagacctatgattatttttttactatccaaggaaaaacatgagctagaaattatatcactgtattgcgttgtaaagaataaattcggcttccatatattccaaacataaacatcccacggaaatatactatcaccatttggactataccaaacacaccattgattgtcaggacttaagagtatataagcattatgaaaattatttggtccattaatcgggatgagatttttaattattgagccattagttgcgtctatcaaatccacacaggattttttattactgacagcaagtaatgatccatcatctgataacgatgcattctgataaccgataagtatatcaccagtataaatgcatttacataagttagactcgacttcatatcgtataatttgttcttgataaggcttatttttgctaatcatacttaaaagtataatggattgattcctattttcaatcaacttatgataacaaaatgctggacttatatcccaaatacagcattcattttcagatgtctcatcgaccaaacatactttgttattattcctatcagcaactaaccattgctttttgtttacaatatattgaataattacactcctgaaaaagtgtttgcgtggtatcccaatatgttcagctgtttgggtattcggatttacgatatccattcccataagctgttcacctaaaaaatccttttttatatttggcatcatcaaagcattcgaagatgaacctgctaacagaaagtgtgttcttccaccataataccttccatgatataatgaaattcttttatctgtttcaatatcatagacacctaaattcccatgcaaatctttggtatataaatattttggatgttcctcaaggaaaaaggcttgcataattgccgcatgatgaccttggggagaaaaagtatattctgatatcaatgaattacaaaaaatcgcagattgtgtattttcagataacgtcacaccatttaaacatatttttcttaaatctaagccagaaaaatccatgtgggataaattccaattatacttttgctccataattcttattaggttaaataaactcaaatcatcattcgcaagagatttttttttatgataattccagtatctatttataatatcataatcggaaggagactgttttccaattgtctcagaaaaatatttttcaacagcagtaggtacaatattatcattccaacatgtgttatttagcactttatattaactagaatttatcaaattattttaactggctttttccattattttgactaattagttatgacaatcacactattttacttattcccgtcaaattacgccaactataatttcaatataaaaagatagtaattttgccttttaacagctaattactatcctcttttaatattaaactttatactgtattctctgatgaaaattcaacgttatgcttggtattgtgctatatgagcgcttattatacttaatccttttgctatcgtcaatccatcaataatactgttcatataacaggctattttttcactgttccagaaaatatcatccaaactgctaagttcactggatactccaatacctggaatatccagccatctcttcatatcaaagttaattacatatacacgatacctgcttccccttgcgcttactgtaaatccagtaattctatcatcgatacttatatcttttaacacacattgccatgaagtgttcttataattacatatataagttatttttttatccaatctcatttgctgcctccattacaatttcattatcaatagtcattttttctctggcagctcctattattaaacaatgagtcagaagattattgagtttgcgtgatgatccctggcaggcattgctcagtgctttaactgcctctggtaatatcaatggctgtgttcttcctgctttctttagtttttcaatgatgtatctgcctatatcatcttcattcattcctgacatttcatactgaataacgattctctgtttcagtgcttcgtgtacagctcggttgattgtatgattaagcactggagttcctgtcatgatcaaaatgacataattacttgaatcaaaattaaagttaagaagcatgatcagatcattgagaatagctgtctttaaatattgtgcttcatccaggatgatgacaggtatgatccttttttcatcaactgtacttttaatatagttttgtatatttctgaagttgtctatttttttatgcattggttcaagtcccaactgactgcacagttcacgatagaattcaatcgtcgtaagtgttgacataggcatataaacaactttataaagtccaggattcagcgattcactaaaacttttcataataaatgtcttccctgtaccacttcttccagtaaaaagtccaatgcccctgatatctttgagatagttgagtcttcctattgcttctttaaagtcatctgtatctatttctatatctggctgtcccttttcaaagggattgaattccatcccatagtatatcttgaaatctttcatagctgttcctcctgtgcaaataaaggcctttttcgttttattcttgaattatcaacctttctgacctcatatatttcgatatagctgtcattttcatatatgaaaacatgacttagatcagggacatatttaattgtgactcttgttccaatatattcctgttttgtttcatagatctttgtattgagtctaatcgttgcatcattgatgacttttctagtaactgtatgatagaatattttttccagctgctgacgatcgatcctctttatcatatgggaatcattcataaatacatttacaggcgtctgcccattcaaagcggcatgtggtgaattgtttttctgattgacatatataccaaaagctttatcgatatcatcaattgttttgaattgggagaaatctgtattgtacatccactgttcttttaccgatttgaaagctcgctccacttttcctttttgattgccatgataaactttggcgtggcttatttggatttgcagctgagcacagatgataggcagttgttcatttttataaggagaaccattatcagtaaatatccttttcggtatgccaaatttaccaatagccctttttaaaacagtctgtacattaacggcattgtcttccagaaaaaatccatagccaacgatcattcttgagcgatcgtcaatgatcatgatcagataggtccttaacttacgaccgtttttattagtgatataagaacagtaggtcgtatccaattgccacatgtcgttggcatgttccatttcaaaggcacgcatatcttcgacaggaaggcgattcagttctggccttgaagcaatgaatctcgatactgttgaaagtgaaacatcctttttcagaatatcaccatcctctattagcttcagatagacagaggtcgctgtcattctcggattgtcggtttttagtttgattattttttctttgatgcactttgtaagcttgcgagaagttcctttatctccacgtattttaggcataagtccatcaaaaccatacttgcgatacagatcgtaccagtaacgaatggtttgaaaagagaattctttagatgttccatcaggatactgaaagggagtagaagaaattctcttataatactgcaaggcagaacggtcaggataggtttcgttgagaacgggaatgatctgttcatacctgaaaagagcgatctgcatatttaaatcttctttttttacattattcatatagaatatacctcctgacataaccatataacacctatatcaggtattcaaaggaaacgttatgggaaaaagcaatcatgaataaatgatcatatttttcgtcaggatacgttgcataaacatggtatgatactctgcaaaatagctgatgatgaaatcaaaactgaggagatcacatgaagaaaagacactcaaaaaagaatcgagacgttccttgtgatattttagataaaagatgataagctttctgacaagttctattgaaaaaccagtgagtttggaaataacagaaatagaatcattggtattgcgaaaagaagtgataatcctgataatattaggattagacaggatgcggtaagggacaatgatgctgggaagaagtgcatgagtacagttgcagctttgacatttgatacgtgtaatagttaattgaacagtatcatttacatcaacctgcaaataacgagtgtaggtcgcatggttgtgaaaatgtccaacagagccacaagtgcatctgatatgggaataatttatttttttaatatcttctttataagagttttgatcatatttattgataaaagttgtttgaaatgataacatatagattgtaaaacatacgttttattttagaaaaagaaaggcaggagggcgatccaatgaccctttctttttttgtatgtcagctcctttatataataataaaatagttaaaataatttgcctatcattttatcaaattattttaactatttttctatgtttattatttttgtttgactaaatagctgttattttaattaaaataattcaccgaataacacatgtttttctatgatgttctatagagtattccgcgcaattaatccaatacttgcacaagaaaaagtcaaaaaagttttgatgagtaaaccaataatttgatttttcaaattcatcaagtaaattcaactgatctaacaaaaggaataatattgatcttatattcaacttatcagatggtttaagtacattttcaataatctctgatttatattcctcagaaccgaacattttaacaacttggtttacacagtcaaaaatatttcgttgactgatactgtttgtttcgcttatataaatattccatgctaattttggtaatatataattcattgcgaccaatgccgtatatgctgagcatagctgcttattatacacaacttctgcaatctgacaaaccatgtagttatgtattacatcagagatacaattattcttacgccaatcaagtcccttcgaatgataatacttatcctttgcataagatgttcctacatataaagcaatcatttggggtagttgcaggattatttttaaaatcggaggttcattatctattattatatttcgattttttaaacactcgtcaattgcatcatcggtcaacggcaacatttcacaatgttcaaactgagtactattacctaaattatagaattcgttgtttctgctagaaataataacagacacagattttaaagagttccatacttctaattcttttgcaagctgactcggattattcatttcattaacaccatcaaggattaacaaaaatggaacatcactggaaactattaaggataacatcttttcatatttagcagctatacttatttcagtatatctgtcatctaagataagaattctatcttttatccacttagcaataggtaatgttgccgttccagaatcatctattctgttgagtggaatgaaaactacaggtattccattctctagtaattcataacttaatgctataagagaaacagtttttcctgcacctcctactccatttaaatataaatgaatcgattgcttgattcttaaagaatctgttacatattcggataaagagtgttcatgagttgaaaactttatttttggcagtatttctcttatgaacttatgttctataaatagatcattataaagatatatggacttttcatactttttaataatatcattccaataagaaatatctgtggcagcatcttcaaatgaatttattccattcaagcatgtgtatttttcaatttttgagattcttctctcaaggtttacagtttttgatagcaggaacgagagatattcatcttgctcaacccaatgcaaaagatatgctgcaaaaataaatgataacgatttatgtatatctgcaaactcagtttcctgcaaatctcctagatacttaatagtctgatttgctaatttgtcaggattatattctgcttcttcaaaaaacgaagactcaaaatgaatatcatcaaaacgcagtgcatttacgcgtcttaatccatcgtaaagaagatcatgtactaaagaataatctgatttaattttcaattttttcgctactcggggacttaatattctatcatactcatacatatcgatatacgaatgtgtcttgctaactatcaagtctattcccaaatccaataatacaccagtccctggaattggagatatgtctcctaatacgccagcaataattctacatgaattttcgatgccgttaatgatattatgctcattcatagttaatttctcctggtatattgtaattgactcatttagttagtcatctacagtataccttttcctttctgttatgaagtgacctttgtcaagtgaaaattacacattcataataaaattatttaattttatcatcaatggcatacaaaagccccaaaatactagatttatcgacagttaaccactctgttatacggagattggctactccaaggttaatggttcgtcaaataagttctaactatctatatacgtgaatcatctataatttatgatattccagatcgcgacttcttttatatcttatttatgccacaaagaaaggaccgtagataactaaacctgcttctccttttttgaggcttttctatgccattgatttcgtgttctttttttctcgatttttgtcctccatttcttattttttctttaaattttcataattgtatagaaaacatctttttacatcttctatattcttcctgtttccattccccatataaatcctgctagttcccttgccactgccatgatagctacattatatggtttccctcttaataccatccttctaaatcttttttgtaatctttctactgccttatctgcatatgctacgatttcatcctcctgtcctttttgtctttttttcaacgcttttgatttctttccaactgttcctcttactaatgcctgtgtacattctaccagtgtctttctaaccatcgcattccccatcttggtgattggtgtattgctgtatttctccgcgctcgaattctctcctggaagcattcccagattcgccataaatgcctttgctgttggaaatcgctgaaaatcactcactgtgacatgtatcttcattgctgataatgtatctattcctttgaaacaggaaattttagaaaccggttccttatattcctcttcttttgaaaactcttctatcctttcatcatatttttcaatacgttcatttaaataatcatagacttttaaatattcatttaatgtttctcttacgattactggcaattctatcgtttcaagccatttgatatgggccactgtccagttgcttttcccctcatatcttaatcctcgtctcaataccaatgcactgatctgctgtttgattctctttcttgactggatgacatcttctcttagacctatatattccttgatttcattgtcatgttctgttggtacatgaacagctttgtatgaatcgtgcataagattagtggcaatattaaaggcatccatcttatcattttttacttttttatttttgactgatccatgcattgttgatggtgctaatataacacatggaatatcatggtatgcaagttcatgatataaggaaaatcctaaacatccagcttcatatcctgttaaaatatccacctcattttcttcactcattctttctttagctgacttaataaatttaagaatattctttacttcagcagcacattttgtctgtgcaataacttctcctgttgatgaattgattccacataaactgtacgtatttttatggacatccatcccaatataaattatacttttcatagtgacctcctattgtcgttatggtatcgactttcataattttgtttttttactaatcttattatgaatcgtaatccactttttgacaacttaggaggtcacttcatattatctatcaaccttgtttatccgtggttgattacggttaaattaatttgtaaaattgaaatatatgaatgttgatttgtatttctcattgtgtcttgactacttctgaaaggatattaccacaccttattcctaaacaatgattagttagatgagtcttgaattcgtattttgcaccagattttgtggtctaagtgttgtggataccatttcacataatttaaacaaaaaggatgttttatcatatgaaattagttggcatcgacattggaaaatataatcatttcttttctatcatggataaggacagtggcgaagttttacttcagcctgtttcttttactaataataaagaaggggttgatttcctaatccaaaaacttaaaccctattctaaggattctgttttgattggtatggaagatcccgatcattatcatttcgccttattaaagtatcttctcaataaaaaatttactattaccttgatcaatcctaaaacgactgattttactcgtaaaataaaaggtggtattactaagaacgataaactcgatacattgactatatgtgatattttatatacccctgaacgtagaaaacagtatcgtatcactatagttaatagttttgatctttttgaaaagaaacaattaaccagacagtttttctaagacagatccagatacaacctttatgcatatgaaatatgattattataatcatacaaatgtatttaaaccaggatataacattcaaacaggtgtgagcgatggaataattaaaaatatttatatcagcagtgacggtaatgatgtaaatacgtatattccatttataaaaaaatattatgaggcatatggaagctattctaagaaaacaccagccgatgcaggatatggaagttatgaaaattatgcatattgtaaagaatataatatcgagttgtgtatgaaatatagtggatattacaaagagaaagaaaaaacaaatgataaaaacagatttaagaaagcgcatatgaaaagggcagaagaaggtggatttaaatgcttggcaggtcatgaatttgaattagaaagagtcactggtcctatgtcaagatttcggactaactaaatgtaagaaaattagttagtttcctctaacatatatttgttctcatattcatttggtgataaatattcacaatgtgagtggattcttactgtattatagaatccttctaaatattcaaacaccagctgatatgcctgatgataattcattatcttaaatctgtttagccactctctttttattaatgcgtgatatgattctatacatgcattatcccatggattaccttttcttgaatagctgcacaccatatcccttgtcagctctcgatacctcctcgatgtgtaatgtattcccctgtcactttgtattactactggattggctgtttttcttctgctctttgctgtttccagacattttaatacctcatccacctccagtgttttacttaatgtccaggctattatttttcttgaatataaatccattatactggttagatatacaaatccttcatcatgtgtgtatatataagttatgtctgtacaccatgcttcatttggcgcctttggattaaaatctctttttagaatattatgtaatctgctggaaaagtcacagtcttttgttgttttagtatatggcttgatatagtgggctttaatgttgttttctttcattagtttccctacaaatctttcactaaccttatgtccttctctttgaagtatctgggttattttaggtgctccatatatttcttttgattccttgtgtatttccttgattctaacagctagtttagctcttcttattttttgattacatggttttcttttaaggtagtcataatatccagatttactgatattcaatttttcaagcatactggtaactgaagctttaggatcagcgtcagattttttcttgatctgatcatacagttcctgcttagttaattccccagtatgccaatagccttttttaggacatctaaagcatcctttgtatccttaagttctttttttagtttggcaatttctttagcttcatcactggaatagttgccactgcccctggaattaattgtaccattattatttttagcatctttaagccacttgtgaacagtactgtcagcaacaccaaagtgtttggcaatagcgaccttggattcatcagggtgctgcagtacatagtcaacaactccctgtttaaattcatctgtaaatgttggtttactcataatcatatacctctttcatttcttataattaactcatgacattgtaccacaggactgctaattcttccatttaactggtacagtttttattctagcaccacacaatcgataaacgaagtaaatatgataaattaaatttcctgtttaaaaatgtgaagactgtacactaagaagcaggtgtacaaaatcaaaatcaggacgaacaattaatcataactaccagttagaagaatatcaaaaaagccagtaaaaatcttcaaagcgaagaaatgaaacagaaggaacatttggtgatataaaaacaaatcaaggatatgaaaaattacgacgaaaaggagaaaatggtgtaaaagaagagatactgttagtcaaaatagaacataatctaaggaaatatcatagatataaacaaaaactgtgaagctgagccgtacgctctcaacttacacagtttattttacactcttcaactatccaagtaattaattacttggatagtttttggcttgaatgacaagaaattaaaaatgagatataaaaaaactattcattcgttacagccccttaaactttactaattacaacattttattaatataattcttctattcgcgctttagccgttttaactgattcatcatcaggaaccatcatatataaatcatcaccataaataggtgaataaagcgttgccccactaccatcaacgctagtctgttgaatatcccaagtactcatatcttctatttgcattcgaactaaacttatcatttgggtttctgaaatatttgtttgaaatgaggaatttaatgtttccaacaatgaatcataactatttaaaatcgttggtgaaagtactttattgatgattccagtaattacacgcatctgattccgacctcgttctttatcaccgtcttcaaatgcatacctttcacgagagaaagttaaagcctcttgaccatttaaagaaatagttccagctttaaaattaccaaaggcttgtggattttgaacttcgataccgcctattgtatcgacgatcttgataagactatcaaaattgactctaacataataatcaatattaatattaaaataggcagcaacatcagccattgtctcagtgattccatataatccgctatgagttaatttatctttctgaccatcaagaatattaaaaggaatatagtaatcacgcggaatgcttgttaataaaacttttttagttgtcggattcacagttatgatgatattaacatcactacgtgatttagtagtgatagcgccatatgtatcgataccactaacataaacactaaatgtgtctttagtaacatctttattttctggggcttccatttctgatatatattgttttgaataaatgacttttgtatcatctgaaaaagaaggataattttcttcaattactgaacggtaagattcattgataataatacagtcaacatcattacaatatagtgcattcaccaacgttactattcctgaatatattttaggcttgatattttctttattttctctttgaattttttttatagttttatcaactaaaccatcatcagctgctaatactgaatatacttttccttttagatcctgcgtatactggtaagaactattttttttaacaattacagaaacagtatctgtttcaatgcgattttctgtttgaactaaagcattcatagttttatcaaaaatataatttaccggaattactaatacacataataagataattactgtttttccagctatttttatttttttacttttagctttatattgactcaatgctaatattactacaagagctaaaaaaatgataatcataatgagcatatatttaaatgacaaaataggatatttattaaatagatataaaatccagcctaagatccctgctaaaataatcataaaatatgttcttatatctttaaaaatctgattcattttttccctcctctttaataaaaggaatcatcttatcttcaatcacagctttaggatgaagataaagtaatcttctagcataatcaatcccataattcaattctaaataatcttgtatttcgtccatattagttcgccgataaatactgttatgaccatcactagcaactatactcaccaaattatatttcaataatttttttaccgtcatttttaccgttgtcccaaaacttcctagtatactgcctctattaatttgagataaacatcctagttttaaccagtcataaactaaccatggttcttggtgaatacagatgtatcgttctggatgagcaatgatcggaattttccctattttaagaatttcttttaaaatcgttgttatatactggggatgttcatcaaatgcaaattctattaaataatactttgttttatttaagccaataactctttgatttattattttttctacaatatcatcagaagcaaaaatttccattcctaaataaacctttaaatcaattctttctttttcaagttctctactaaaattatcaaaagatttaattaaactagcatcatagaaattttcaaaccgctttatttgattactatgcggggtaacgaccatcgccctaactccactttcaactgcaagtttagccattgctatcgattctgccattgaatctgccccatcatctaaatccggcaagatatgaacatggatatcgatcatagatcattaccccttatctttatatccatacccataaccatagccatatttaccataaccataactaccataatcatgaatattatgagtataaaaattaaagacataacctttaacacagctttcatcttttaacattgataaaccatcttgtattttttgatgtggtatgaaatcatattttacaacatataataacgcatcaccataatcttgaagctgcataaaatcttgaaatatcccgcaaggtggtgtatcgataataatataatcaaattgttcttttaatttatttactatctcttttaactttattgtatccatcaaaccagctggttcttctactgcttgataaacaaacaattcccaaatattagttcttttattaaaataaacattgtcttctaaagatatttttccagttaaaatatcaactaatgaattattttgtgatttttctttatcaaatactttatattgtgctggttttctaaaatcaccatcaataatcaatacttttttattcttttcaactagtgataaagctatattagcagttactgtcgatttgccttcgttttcactaatactagtgactaaaattattttttgctgatgtctatttaaatgattctcgattcgtgatgctattttacgatttgattccacaaaactcatactaacgataggtgaactaatgagtaatgcctgattagatttttttgttttccctttcttcttttcaaaaggaacaactcctaatatcttaccatctaatagtttagaagcatttttacttgttttaagtgtatgtctaaataaatataaacaaacaataattcccgccattacagcagctgctaataaggctaattcattacgacgattcattaatatcggactattagatggtgatgttggtatcgtcggctcttgtaaaatttgtaaagatgcgttagtaaatacataatctgatacttcgtcatagtgttttaaagctgaattcataaaaaggtaactgttttgcggattattggttgttactttcaacaccaaaagatttgtttcttgaacctgctcacagctgatcacaccatcaatcgtcttacctgtttctttttctacaagttctttcattacatcactttgaaaaacttctttgattacatcggccatttgtgtagccattgcaagtgaggtataagtattactatcacctttggcacttactactaaagtcgatgaaacagtgtattgaggcacataaattaattctccaactccggtaactgctaaccataaagaagcacctgcaagaatgatcatccaccagttttttaataaatccttgataacccctcgataattaatcgaatctaaatcaatctcatcctgattcatttcttcttctcctttacaatttattcaacaactgcagttaaccaggtttcacctttatctccagacgaaaccgcactataatgaatttcatatattcctagtgtattggtatcaacttgagaatcaattgtgacattctttttgttaaccttctttttagaaatagtttcaacacttccaatatattgatatggatcgatcgtttctccagcgttaatataaacaattccttcggttagttcaatattaatactttgattttcactttttactatatgtatagggatttccattgtactaacatcaccataactattgcttacttctaaagttaaatgataactgcccgccgtagtatagtttacatcgctagtgccttgaattattgattctgttaaatcaccatcaagcatatcttcagccgttatttgcgatatcattttttgataattcccctctttttctatatacactaaaggtttagccgttataaatcttggtgaatgataatctgtgaaacgaacatttctagtaagacttgttgattgattagaggaatcaaaaacaacataagtaacactacaaagacctttatcaataaatcttgtcatatttcctactaatattttattagttagatcaccatcttctttatcaaaagcacttaatccatctaataattgttcttgagtatattcacaaggaatctctaaaacatcacgatcacttgtgatagttggtaaagtaggatccttactaattaattccttgctcttagctattaaaaaaacacctaaggacaaacagaaaactatgataacagtatatcttattaatttcatctatcttcctccattaaacctcatttaaaaaagcctctatttcttcttcattcacttcatcaattcgtccctcttgaattttataaacacgatcacatatagataaaacactagggcgatgggcagttacaataatcgtttgtaaaggatcacgacgtaaaatattttttaaaacctttctttcactaaccatatctaaagcacttgtagcttcatcaagcaataatactggcgctttagccatcaatgctcgagcaatactcaatctttgtttctgaccttccgaaaagcgatttcctccttcacttacttctgtatggatccccttttctaattgggtaacaaactcccaggcacaagctgtttttaaaacttcgatgatctcttcatcgctagcatcaggtctaagcattttcatattgtcagctattgttcccgaaaacaaagtattaccttgaggaatataactaaataaacatctcgttcctgaactaataggaatagtttcatacccaggattactcacagttactgcacctgctttaggatgatataatcctaacaagatccttaacgtcgttgtcttaccttgacctgaaggtccaatcaaaccaatgatttcacctggtgaagcaatcatattagcattttgatatacataaggattatcaccatatcgaaaactaacatctttcatttctactgtaattcctacatctttagctttagctaaaagcttttttgcttcctgctcatcttctagagactccctaggtaattgaataatttccatgattctgccagcactaataccagctcgcatcgctgttggcaataaatttaaaaccgatgaaaacgatcctcttaaagatgaagacattgacacatataatgtcatcgttccataactaatatctccctgccatagtctatatgctgcaaaaccataacaagcataaccaatcagctgaccaataaatcctgtcaagatcgtcattttagattgaaacttattttggagcatcgataatcaatcgattggtcttgtacatctttatattgtttaataaaataatcaaccaagccaaaggctttgatcatttgcatattttgtaatgtttcttgattaaatgatgtcttatgactttgcagttccatttgtttacgctgaaaatcacgcatttttctcatagaaaaacgggtgctcataaacgaaattggagcacctgctaaagcaattaatgccataataatatcattttgtaccatcacaataaaagcaccgccaaatgaaatcaagattgaaaccacattaggtaaatacgttaaaatattgttagaaaccattgcagcatcaccgttgattcgatacattagatccccgttctatacttagacaattcttcccaatcagtctgtaagatctgagaaaaaatatcaattcggatctcattattcactttcatactaatgcgtaatgataaacgcgttttaaaagcattaataaacaactgtgacacccctacaccaacatataaagcaacaactcttacgattcctaaagaattctgaccagtaattgcatctaccaaatctctagaaaccatcgatgtccctaacgttaaaaaagaacccgaagcccctaaaagagtatatgttccaattaaaaaccaatagcgtttcatatagcttcccatccataaccattgagaaaccagctcttttaggcgccccttttttattctttttatgtagtgtttaatctttttagtcattcaatatagccctttcaactaactcaactgattcttcatcaggtctacacttcaacaaataaacaggcacccaagataataaaccatcaagcgttgccattactgcttcaacccctatttcataccagtgtggtaaaaagacatttgccagcactctttcaaccattctaataccatcaagtttttctatcgtattttctaaatcctgctgcaatactacaattcccgatagtgcaacttgtctattttcacaatatggtgatgatccatgccatggacagccacatccccaatacgtttgaccatcatcatgaactaacgccatatcaccattaataattactgcatcacgatacttataccataactctgcctgtgttgtcttaccaatacctgaaggtccaataaacatgattcctttaccacccacatcaacaaggctgctatgcatcatcattccatgacgagtcgatagatgtgtcataatcgctgcaatcaacgctccctctaagccatcactttgaccatcaagcaacgtgatactcgctttactccaatcatcattagcacttaacaaagcattttgacacttcaatacagcacatccaggttgcggttcaaacacttcaacaccatatttatgcacaagttgagaacaaacattaatttctagatctgctgtcttaacgttacttttaaacaactcccacgaaggataatcaaatgagtatttacatagctttatgacttttttacatatttcaaacattaatgaactgtccaacatccaaaaaaataactattaaattcatctatttctgcctttccttcatcgccgcttagagcaagtcgtattattcttgaagcataatttgccatttgcgtattgattgcaagaacaacagcaggatctccagaatcaatttgctcttgactataaccccgctctatcagccactctttaatgttttcatctgtagcagtaacgtttccagctgctttaggacctaagaaatatccccatcgccccgtaccatcatattgagaacctgtaatacctccaggtaacttccatgatattgtcaatgttcctgactgattacctgaaaaatcccctgaagatccaccaatatcagctggcataattcctgaatccatattttgaccacctatacctgtatagggtactgttacttctccgtacataaattttcctccttaactcttctacttatatctatcatttcttttatctttttacaatattctttatctaatttgtttagaccaccactgaaacatgctagatgagccaaacattttttacactgttttttatactcacatgtatagcattcatctggccatcttagtttttcttgataatctaaaagttctttccaacatttttcaagtgattggttaacaacagatatatgcggctcatctaaaaacaaacagaatctcatattaccatcccaagtaatattaaattctttatgataacctgagcatcttttagccggtatatcatcattggatggcggtaattcattccatagttttgaagtttgttcaataccttctggatcccatatttctattgcacatttttttgcttcactttgagcacctctcaatgatggataacaagatgcactataataccatggtaagttattttcttttgcatattgcataatattttgaatatcttttttattgtttttgataaatgttgttacaagctgaatattcatgtttctatcttttaaagcttgaattccagcatttgttttagtaaaaccattttcaatacaacaaacatcttgataaacttcatcatttgaaccatataaagttattttaactgtttcaggcggatattcttctaatacatccaggatatcaccactaagctgtgaagcatttgtttgcagtgtaagtaaaaatcccatttgtgataagccaatccatatttttttaaaatctggatggcacactgggtcccccccagttatacaaatggaaaaaacgcccatttcaacggcttgtcgacctatttctaaccattcatcaccagttaactctctaccatctccaactttagatattctgtctacaggtagatgtacatagcacatccgacaattaaaaccacatcgaggcgttatttcaaatgttgcatgaatgggaattgcattttcatatgctttttgctgcatctttgctaatttgagcataccatacaaattcttctgcattattctttagaacccttttctaactttttgatttcttcttgcgaaagttcaattttaaccgagccagtagctggtaatggtcgaccattgtccaacatgtaattgttatctaatagttttaaaaaagcttggatatcttttcttgccatttcttcgctcactccagaaaaatgtcccatcactgcttctactaatgaatcttctgtgaattcatcatttttcataatattccataaccaggctgttgaatctgtaatttccatcattggcgatacttgtgataatcgtccgattggaacaacaatgttctctccagccactttacgtaaaacaagatctttttttaatttcattacaataatctccatttttaataatgttttattaataaaaatgcaatatataaacagataatttctcttataatatcatctaacatcaaattttattaatcagtttgattatatcataatttgtttgatttacaactttctattacccaaaggcaagttttatgtttaaagcgcataaaataataatattaaaatttatttttgtttttttcataaaattaatttagttataaagcatcaatgagtattgttttatattatatagttttttaatattttatagatatttttaaagtttgtgatattatataagaaaaatatgaattaggtgagattatgaatattattaatgaattatttatgaagatgatatcgtgttatatgcatgataatgaatttgaggaatctatatcttttttaactgataaacagtggcaaaagctgcatgatttttctaaaatgcattatttatcgccaattgtatatgaagtcgttaagaataatgattcttttaaacaattaccggatttgtttaaaaatcaatggaaacaggaaactatttctttagttattaaacagattcaattaagtgaagcttttttgaaaatatatcaggaaataagaagaacaggtattaattgtattgttactaaaggtattgttttaagagaattatattcaaaaagagaatggcgcgtatctggtgatgaggatatttttattaaaaaagaggattttaaaaaggtgcatcagatatttattgataataattatcatgttataaatgatgttgccaatgagaatattccagttattacttatgttgatccaataacagatttaaatattgaacttcatttacaattatttggtaaagatacttatttgggttttcttaatgattattttaaggatatttttgatcattgcatggaaatagaaattaatagtgttttgatacaagtgatgaatgaaaatgatcaattgttttatttgatttgtcattgctttaaacattttattaataatggtgttggtttaagacagttgatggatattggaatgtatagtcaaaaatattatagtacgattgactggtcggcactattacataaaacaaatgattttaaaggtaatttgtttgttcattgtatttatagtattcttgaagatttttttgatatttcaatgattagtataaactatcctatacaactaattgataatttagattatcatgatattttagaagatatctttgatagcggagtgtttggactttcaagtgaagaaagaatttatagtaatttagtcaccagacgggttattaataaagaacataaaaaaattcctttacgggaacttatttttccatcagctaaaaaactacgcgctggttatgccgttttatatgatcatccatatttattaccatatatatggataaaacgaattttaagatttcttattcgttataacagtagtcgaaaaaatagtaatctcgatataacaaaatctgtagttttaggtaatgaaagaattgctttgttgaaaaaatatcatattattgattaaaatagctgtttaaaaactattaaaatatttttacatgctttgtagataaggaggttaacattatgttaactagtaaacaaattatgaatgaaatttgtaaacgcattattatattatcacctcaggaaagggttatttttttaaaagagttaggaattgaaatttcaatagaacaatgttcatcactgacatttgaaacagatattattgatttaattgagcatttatcaaatagtagtgataataaaactatttaatcctactaatattaaaacaactaaaatataaacaactctctcaaaaatgtcaaaattcacaacatgtataaacgggccaaagatagtgttgaatattatcttcttaagtaccagagctatctattactaaaaaagtgatattgaagacaacccaccttgatacaataaaaaataagttatcttttaaataaatcacaaatattagaattgatacttaaaatcgatacaatattaaaacaggtatataaacagaaagaaaactatcttgtcttcattgaagattacatatacgaaaacacatcaaaaaatatgatgggttttataattagttgatggcattaaacatcaatgagtttaaaggtgttgtgaatataaaacaataagagctctttaccaacatttaaaatcaaaaaaacaaataaataaccaggtaacccaagagatctatataagaaaacagataataattaaataaaatagttgtttgaacatattatattaaaagtaccattcttgaccctagggtattgaatggtactttttcaagtataaacagaagcagcgtcatcaaaacctatattattttaagagtctcattttttattaaatatatcttaatgtaacagctgctttaccaatttaaatataaacttttgttaatgtataatagtttaaatgttatatctctaatttacttcttctattctacaactatgtttttttgtctttttatcataactgattcctactatcagtaaattatccctatatttttccaatccctttggatatttcttttctttgatttgatctatcgctgtctctgcttcatgatcccattttaactctactatcattgctggtttatcatctttaggaataaacaccatatccgcatatcctttcccacttggcatctctcttattatcgtataatgatttcttgcatacatatacgcaatcgaaattgtataggataacgcattttcattattatatgttagtatcgctgtatccagatgcgcttcttcgatatacttagctactaattcttcatctctattccatgttgcttctaataaggcgcgactgtttaataacgccttcgttgtttcattccagttagaacttcttatagaattaacaaatgaatcgataacttctttattaggtatataacatgtctgattggaactgttatatcctagataacctagatgtatcagcagtgtcaagacatcatcttttgatttgaacgtcgtcatatcattttgaaatgatgttgtctgtacagcgacatgctctcctgccaacaacttcacaatatcatcttttaagccgtcataattcatatcgatatacactcttaaggcttcatacgtctcggttgatgtccaataattcccaaactttttccttgtgatcgatgctacaactgatcttggcgaaaatgttgatatcgtatctgtcaaatgataaccatcataccattctttcatttcatcatagctgatattatactgatgacatagttcttcaacttccttttctgtaaaacccatatattctggtagaagttctggatcaaccattgaaatttcatcaaacatattcaaagcactatgagttccatatttcttgattggcaggattcccgtcatataacataatgatacataaggtttgtcctttaacagatttctcaaaaaatccagatacttctcttgggctcttttatctccctgatattctctaaagatacagtcccattcatcgataacaaatataaatcgttcatttacctcaacataaacatcttctaaaacttgtataagatcatcaatatcaaaatattctatatcttgatagattttttttatatctctaaaaattaatttcgttagaagaataatcatcttatcaacatcgtgtgttttacttaaaaaatcctgcatattgatatgtatcacattatgctgatttaagtgcttttgatataactctgtttgactgatttttaaatctttaaaaatatttgacgaatcacagcctttggaataataagctaccagcatattggcatcggtactctttccaaaacgccttggtcgtgacacgcataatttattattttctgtgttgataattttatttatattttcaatcattaaactatggtctacatatatttcactattcttcatattctgaaacagtgtattttgtggatttaaatagattcccatgcctatcgcttcctttcatagagttattgtaacattttttatttgactattcatcaatacttttttaattgaacacaccttagtatgccagctgctttaccaatttaaatataaacttttgttaatgtataatagtttaaatgttatatctctaatttacttcttctattctacaactatgtttttttgtctttttatcataactgatccctactatcagtaaattatctctatattcttccaatccctttggatatttcttttctttgatttgatctatcgctgtctctgcttcatgatcccattttaactctactatcatcgctggtttatcatctttaggaataaacaccatatccgcatatcctttcccacttggcatctctcttattatcgtataatgatttcttgcatatatatacgcgatcgaaattgtataggataacgcattttcattattatatgttagtatcgctgtatccagatgcgcttcttcgatatacttagctactaattcttcatctctattccatgttgcttctaataaggctctgctgtttaataacgcctttgttgtttcattccagttagaacttcttatagaattaacaaatgaatcgataacttctttatttggtatataacatgtctgattgaaactgttatatcctagataacctagatgtatcagcagtgtcaagacatcatcttttgtatcaaatgttgtcatatcattttgaaatgatgtcgtctgtacagcgacatgctctcctgccaacaacttcacaatatcatcttttaagccgtcataattcatatcgatatacactcttaaggcttcatacgtctcggttgcactccagtagttttcgtattttctgtccattaaagcataaacaacagaacggtggttataaactgataaatcatctgtcattttatatccatcataccagtctttcattttttcatagtccatatcatattttaaacataaatcttgtacttctttttctgtaaagcccataaactcttccagtggtgttgggttgagtatcgatacttccttaaacatattcaaagcactatgggttccatatttcttgattggcaggatccccgtcatataacataatgatacatagggtttgtctttcaacagattccttaaaaaatccaaatactgactctgggcttctttattatttttgtattctctgaagatacagtcccattcatcgataacaaatataaatttttcttttatttgattgtatgtttttaataaatataaagataagatatttctattattttttactttaaaacattcatcaagctcttcaataatctcttcactcaataattcaaccatatcatttattgatgatgaaatacttaaaaaatcctgcatattaatatgtatcacattatgctgatttaagtgcttttgatataactctgtttgactgatttttaaatctttaaaaatatttgacgaatcacagcctttggaataataagctactaacatattggcatcggtactctttccaaaacgccttggtcgtgaaacacataacatcttatttgacgtacgaatctgatgatttgttttctctatcaataagctatgatcaacaaatacttctcctcgcagcatttcagcatatttttcattatctggatttaagtagattcccatgattatcgcttcctttcatagagttattgtaacatttttttatttgactattcatcaatacttttttaattgaacacactttagtatgccagctgctttaccaatttaaatataaacttttgttaatgtataatagtttaaatgttatatctctaatttacttcttctattctacaactatgtttttttgtctttttatcatagctgattcctactatcagtaaattatctctatattcttccaatccctttggatatttcttttctttgatttgatctatcgctgtctctgcttcatgatcccattttaactctactatcatcgctggtttatcatctttaggaataaacaccatatccgcatatcctttcccacttggcatctctcttattatcgtataatgatttcttgcatacatatacgcgatcgaaattgtataggataacgcattttcattattatatgttagtatcgctgtatccagatgcgcttcttcgatatacttagctactaattcttcatctctattccatgttgcttctaataaggctctgctgtttaataacgcctttgttgtttcattccagttagaacttcttatagaattaacaaatgaatcaataacttctttatttggtatataacatgtctgattgaaactgttatatcctagataacctagatgtatcagcagtgtcaagacatcatcttttgtatcaaatgttgtcatatcattttgaaatgatgtcgtctgtacagcgacatgctctcctgccaacaacttcacaatatcatcttttaagccgtcataattcatatcgatatacactcttaaggcttcatacgtctcggttgcactccagtagttttcgtattttctgtccattaaagcataaacaacagaacggtggttataaactgataaatcatctgtcattttatatccatcataccagtctttcattttttcatagtccatatcatattttaaacataaatcttgtacttctttttctgtaaagcccataaactcttccagtggtgttgggttgagtatcgatacttccttaaacatattcaaagcactatgggttccatatttcttgattggcaggatccccgtcatataacataatgatacatagggtttgtctttcaacagattccttaaaaaatccagatacttctcttgggctcttttatctccctgatattctctaaagatacagtcccattcatcgataacaaatataaatcgttcatttacctcagcataaacatcttctaaaacctgtataagatcatcaatatcaaaatattctatatcttgataaactttttttatatctctaaaaattaatttcgttagaagaataatcatcttatcaatatcgtgtgttttacttaaaaaatcctgcatattgatatgtatcacattatgctgatttaagtgcttttgatataactctgtttgactgatttttaaatctttaaaaatatttgacgaatcacagcctttggaataataagctaccagcatattggcatcggtactctttccaaaacgccttggtcgtgacacgcataatttattattttctgtgttgataattttatttatattttcaatcattaaactatggtctacatatatttcactattcttcatattctgaaacagtgtattttgtggatttaaatagattcccatgcctatcgcttcctttcatagagttattgtaacattttttatttgactattcatcaatacttttttaattgaacacaccttagtatgccagctgctttaccaatttaaatataaacttttgttaatgtataatagtttaaatgttatatctctaatttacttcttctattctacaactatgtttttttgtctttttatcataactgatccctactatcagtaaattatctctatattcttccaatccctttggatatttcttttctttgatttgatctatcgctgtctctgcttcatgatcccattttaactctactatcatcgctggtttatcatctttaggaataaacaccatatccgcatatcctttcccacttggcatctctcttattatcgtataatgatttcttgcatatatatacgcgatcgaaattgtataggataacgcattttcattattatatgttagtatcgctgtatccagatgcgcttcttcgatatacttagctactaattcttcatctctattccatgttgcttctaataaggctctgctgtttaataacgcctttgttgtttcattccagttagaacttcttatagaattaacaaatgaatcgataacttctttatttggtatataacatgtctgattgaaactgttatatcctagataacctagatgtatcagcagtgtcaagacatcatcttttgtatcaaatgttgtcatatcattttgaaatgatgtcgtctgtacagcgacatgctctcctgccaacaacttcacaatatcatcttttaagccgtcataattcatatcgatatacactcttaaggcttcatacgtctcggttgcactccagtagttttcgtattttctgtccattaaagcataaacaacagaacggtggttataaactgataaatcatctgtcattttatatccatcataccagtctttcattttttcatagtccatatcatattttaaacataaatcttgtacttctttttctgtaaagcccataaactcttccagtggtgttgggttgagtatcgatacttccttaaacatattcaaagcactatgggttccatatttcttgattggcaggatccccgtcatataacataatgatatatatggcttatctttcaacagattccttaaaaaatccaaatactgactctgggcttctttattatttttgtattctctgaagatacagtcccattcatcgataacaaatataaatcgttcatttacctcagcataaacatcttctaaaacctgtataagatcatcaatatcaaaatattctatatcttgataaactttttttatatctctaaaaattaatttcgttagaagaataagcatcttatcaatatcgtgtgttttacttaaaaaatcctgcatattgatatgtatcacattatgctgatttaagtgcttttgatataactctgtttgactgatttttaaacgattgaatatttgtgatgaatcacagcctttagaataataagctactaacatattggcatcggtactctttccaaaacgccttggtcgtgaaacacataacatcttatttggcgtacggatcagatgatttgttttctctatcaataagctatgatcaacaaatacttctcctcgcagcatttcagcatatttttcattatctggatttaagtagattcccatgattatcgcttcctttcatagagttattgtaacattttttatttgactattcatcacaatttgatactaattatagtttaattttattttataatataggattaaaaatattgtaaaaatatattagaaaagccacttaaaataaaatgagtagcttttttgacaacttttaattcatttaaatatatctaaatttacttaaatacaactaagtaaattaaaatcaaaagataaaataaaaaggcttaaaccttagtaaaacctagtgtttaagccattgtttacaatggtctcccctcacgattataggagttaatcattacatacaattacacgctattacatgacgctatatcaagggttttaaggcacatactaggttacataccgatacgtgcctttttatttgacactcaaaaagtgtcgaaaatgtgtcgagtttatactgcattcattgtctcttgaacttaaaaaattagttaaaaaggacttatctagtcctttgttaatttatacccctttattgcttaggcgccattttgtttatagcatccatattatatttattattagttttcttatccattttatcactaatttttaaagtttcttctacaaaaagcctatcgcattcatcagatgatacccctttgtaaattccaaggtcatgtatgtaactataatattgataatttatatcacacaaagcttcatttaatagtataagttttttatcataatcaaagaaatttgttaaaaattctaaaaatgcaagaattgcagttataactattacaatttcattactatagatatcaaaacatattaccactggtatagatgctaataaaagagcacgaccaaaagtaaatattttcaaacatattttagcagttttttcttgctttatgtattgtttttgtactttaattaaatgattaaaatattcatccattctatttaccttttttcggtttgagttctgcatcaactctgtttaatggtcgctctctttttgtataattaccatactctttttgcggtctaggtactgagtgtcccgcgggcctacctggcttttgaggcacttgtccagttttaccataatttgtattagccatttgtttttcctccctcgtattatgatatttgattatagcatacatacaattataaatcgacacatgactaggtaaaactttatatattgatataaattattaacaaatcataaatttcacgaactgaactcaatttgatttaaccttacataaagtccataaatttatgggtaatctaacaagattagagaaccaacataaaagcatgggtattcgtcactaatgaagaatggatttcactcggcctaaaatcaggctcagcaatggctataatgaaaaaaaactaaaggattctttacctttagtctttcaaatcaattaaacagcttagcattgcatagcatatttttaacagttcctttttggtaagctccataaacttacctcgttcaaggtccattaaatcatctttagtagcatttctaaaatatttgttgtagtcaattatcttcatacggttcacctctcatgacataaatagcacttatttttatcataagtataacttatatctaatggtaagtaaatacattggcctagattcagctttttctttcgttatagaagcgtttaagttattttggtataaataatcatattacagcaaaaagccctcatacgttaaatataaggtttttttgtgttttctaaattcagataagaaagaggtaaatgctacaattttaaaattatctcttgactttttgtgtacctattatataataattgtgtacacaataaataaggaggtgtatatatgagcccaagaacagggcgacctaaagttgaaaaccctagaaaaaatcaaacaaaaataagaacaactgatgaagagttaaaaaaaatcgaattttgttctaaggaacttaatttatcaaaaacagatgttattcttaaaggtattgatatggtttacaacgaggttattgaaaataaaaaaataaaatagagagtttgctcgctaaaacaataactctctatttacccaaaaaggcataattattgtactacattatgcctctaaaatcaaataagaaagaggtaaataaaatgggtagaccagtaaatgcattaaagttaattaaaattacaaaaggaaatatcaatagtaattatgttatgagtattgataacgtttttgatattaaaaatagttcaaaagatatatatagtgtgatttataatgcctttgtgtttggatatgcacaaggagctaaagcacaaaagaaaggatgcgcttataatggatagagaaacatatgaaagatgtattattgagcatctaaaagatttaagtgatgaagcattaaaacgtatgtttgattatcttaattatttgataataagagattttagaaaggaaccagctaaccatgaataaagatttagaaatactaaaatatcaattcttgaagccggtatctgaaaatcaagatagtctaagagaaataagaaaaacttctaaaaattttacaattgttgacgcgttcctgctgggagtaatagttggaaagcgtgaggaaaggaaaaagaaagctcatagatcaaatgaagatccgtttaaaacatacataaagtcactgatagatcaaacaaaaagacgtagatctttaaggctcgtttgtaaatatcttgaaggggctagatttataaaataactccaaaatataatatattacacctgtagataaagcaggtgtttttttgtgttattgtcgttttgtaaatgcatcccttaaatttaagggttgcaaccttttttttgttgcataagaaggttgcaacccaatcaataaaaatcacaacaaattcaacagttatgtgctgatagttgtatttcccctatgtaaaaaaatcttaacatttcttaaccgttttatcatttttgtgtgcatacttttttgtatgcgtacttttttgattttgtacgcaagttgtttaacaacttgattttatatcctccaatttattgtatatgcttttttaaccatagctagcttactgtctgcggacgtttagaccaatcaggatattttatacccgttacctataaatgctcctagaaccctttattttagctggtttaagacatacaaacaaaaagccccctggagggctaattgtctaatacatcaagcggtttgtacaaggtgctgatatgatcttgccatagtccgctttcatcagtgaaaagaaatgcgtcatagctttgaccaagacttacgatcatgttctttagctcattgtaaagcgagtcaagcaacttactgcagttatccaaattcagatcaagaatatcttcggttagatctaaaccgttctttagtgcatattcctttaaaattctaatcattgtatggttggtgctaaatttatctgcaatagccataaattcctcgtgactgagtttgatgcctgaatttaataaagcggttgtttcattatcaatatcactgcctttaggcgtgaagtagtctttcatgaacgttctaaacttttcagtttcatcaacaagcatctgatcatacttttcaatgagttcattttttcttttggtcaagtccatttcaaaatctcttaggtattcagcgttgtatatatttttcttttcttccagctgtttttcctgtaagttgatggtattaagttctttaaaaaatccttttacaacattttccaattcagttatgtgtttgttactcattatcataccctccaattttatatactgtgcatatcgtcatttaaactgtcattaataaactgtgtcataccaacaatggctaaatcactatcgttgttaggtgtcatgatgtagttttctatattcagtttcagtttatttaacgttgtaatggttttttcattatcaggtaggggcaatagttccaaataagtattacccgatttactgactgcagcattaattgatttaactgcaataatatcatctttatagaccccatacatactttggagatcgtcatttgataatgcattactgctaatggcatttacaaggttttgcagtcccaactgatatccctgatttaacagacgttccttgttagccttatccaatttaaccctatagtcactgatagcctcatcaatgatggtgtttaatgaactgcctatatcatggccaatattatttttagcctgatgtgtagttaatttagccttgcttttatactcaggattgtaatcactgctctttaaaatattatccaacttttgattggttgcattaatatcacttataaacttattcaacttgtttaaaaaaatgctttttctactcatttttatttacctcatttcttttttggatcatatgtcttaattccatatatacgtgtgaaacttaacttttcttaacattttgatactgttgtttattcctgaatgcccataaaaagttagcattgatgttataaaggttttatatctattctaacaattttagcatttttaggcatagcataaccctcaggacagaaatatataaaatcaacatttttattatcaatccattcttgaatgtcatcctcatccatactgttaaactgtttccaatcggttatattcctgaagttcaaaagtcctattagaactttgtctgtacctttgaaatatctttgctcaatgaatgttaatatttcattccatgtccgctcttttatgtcggctatataaatattttgaaaagcggtatcaccatttttatcaaaatattcagctctaatatatttttccattatttgctccttttttgttgtgtttttttgaaatagccatcattttagaaaatgccactctttctagactaactaataatatggcgttttcaagagaaaagctatatgtaccaacggttttatagaaaacgccatgtggttatctctaactcttagaaatttagaaaatgccacagtggcgattactaaaaacactgattatatcaatatattttatagaaaacgccatattttttatgtcactagagagataaacctataatggtcttttgtcctccctcgctttttggtgatcctattctttttatttctattaagccctcttttttcaattcagctttagcacgttctaaagttcttttactaatagacattgctatggccatttcgtttaaatcgtttgcctctttatcactatcttttaaataatcgagtataaattctttagcctcgtctctagaagatgcacctttacgactatatgatttactgctcatataatcatggtccttgagtttagaagtacctttaaattttggtattccatcatcaaccgtaaataaaactgtatcctgtaatgctccaagattatttttttcatggctcatatagcgaatgttatcttcaccagtattaccaacaataagaacacttctagcaatatcccatatatcggaactgtcagacattctacttctacctgatgcattctcacgtttatttgtatggctcatgatcataaagctagtaccgtatttttcacctaagcctattaatggatttaaaacatcacgcattgcatttctataacccatattcacattgggaggtataaagctctgcaatggatcgaatattattagagccggtttatatttgtctataagccgttctaataatggtccattaaattttatatcaccaaatctttcgtcacttagtgtaatagtgataatgttagacatattggctccatttagcctaagacgtctttttaatgtgtaacttgggtcgtcttctgatgagaaaaacataactttttgaggttgcctatccaatatggcgcactcttcaaagaaacataagcccccattggaaatagctgcagctatattgcaccataaggcagttttaccaacaccaccatcacctgtaaccattgtgatctgtcttttgggaacacagttataaataagccattcggctggtttttcttcgacctcatccattgaagttacatcaagattataagttttaggttgctctatatatgatgacgtccctttttgatatttcaatgcactctcaactctggctttaacatattcaaaatcataaggcggaacacatttttttaaattttcttcccatactgcttgacgtatagcctcatcacttaaacctttggcctgtaaactgcaagctagtttaaataatgtatcgtctctacaaccgtcttctataatctcaccaatatgtaaactttcttgtcctttattacctttaggtccatctaaaaaattgtatactgtatcatcagctatagcgattggtttattattgatccatttataatatttaccgtttatggagcttggtggagcaacaacatatcccccctcataacggatatcaatacctggataaatatctctactattagcgtgtttataatcattggccacaagataatacaaatgataccctccactaggagttactgcttttgcagtatcaggcagatttttaccatatctttcaatggattctaaaccgcttttacctttttttgtatcaacatctattatgatcagtttccctccatctaattgacttccaccgcagatacacacattagcattaggccatttagtccaccatgacgttacagtgttaatatcagctgatgcctcatttagccatgattttaacagttgattattgatatttttatctttgtttatatttcctttactgttaggcctaacagggaaaatttttatacctgagtcagcataatactttacattttctaatatgtttaaatcattcatcagctacctcctttctaagaaatagcacataaccgtacgccaatacattaattgataccatttacttccttgtagctttctagcgcttttaccttgttgcttacatctaaccccacatagtcacgttgaaaacgttttatttcagcttgtgagaacatatagcacttgcccgttttagtagccctgatgatgccgacttctctaagcattgtaatttgatcacgactaacattaatcagttctgatacttcatcttgagtaagcatttttaaatctgtcattgttttaatcctcctaattctttaatatttctgaaacttcaacatttaacgctttggctaattttccaacagtttttaagttgccaactctattgcctgacatgattcccataaaagtactgtatgggaagttgtttatacgacaaaactgttttgcattaagctctcttttagctatttctactctgattttttgtgtgtctaattccatagcattaacctcctttctgttatgaagtgacctttgtcaagtgaaaattacacattcataataaaattatttaattttatcatcaatggcatacaaaagccccaaaatactagatttatcgacagttaaccactctgttatacggagattggctactccaaggttaatggttcgtcaaataagttctaactatctatatacgtgaatcatctataatttatgatattccagatcgcgacttcttttatatcttatttatgccacaaagaaaggaccgtagataactaaacctgcttctccttttttgaggcttttctatgccattgattttgtgttctttttttctcgatttttgtcctccatttcttattttttctttaaattttcataattgtatagaaaacatctttttacatcttctatattcttcctgtttccattccccatataaatcctgctagttcccttgccactgccatgatagctacattatatggtttccctcttaataccatccttctaaatcttttttgtaatctttctactgccttatctgcatatgctacgatttcatcctcctgtcctttttgtctttttttcaacgcttttgatttctttccaactgttcctcttactaatgcctgtgtacattctaccagtgtctttctaaccatcgcgttccccatcttggtgattggtgtattgctgtatttctccgcgctcgaattctctcctggaagcattcccagattcgccataaatgcctttgctgttggaaatcgctgaaaatcactcactgtgacatgtatcttcattgctgataatgtatctattcctttgaaacaggaaattttagaaaccggttccttatattcctcttcttttgaaaactcttctatcctttcatcatatttttcaatacgttcatttaaataatcatagacttttaaatattcatttaatgtttctcttacgattactggcaattctatcgtttcaagccatttgatatgggccactgtccagttgcttttcccctcatatcttaatcctcgtctcaataccaatgcactgatctgctgtttgattctctttcttgactggatgacatcttctcttagacctatatattccttgatttcattgtcatgttctgttggtacatgaacagctttgtatgaatcgtgcataagattagtggcaatattaaaggcatccatcttatcattttttacttttttatttttgactgatccatgcattgttgatggtgctaatataacacatggaatatcatggtatgcaagttcatgatataaggaaaatcctaaacatccagcttcatatcctgttaaaatatccacctcattttcttcactcattctttctttagctgacttaataaatttaagaatattctttacttcagcagcacattttgtctgtgcaataacttctcctgttgatgaattgattccacataaactgtacgtatttttatggacatccatcccaatataaattatacttttcatagtgacctcctattgtcgttatggtatcgactttcataattttgtttttttactaatcttattatgaatcgtaatccactttttgacaacttaggaggtcacttcatattatctatagtgtgattactcatataaagtaattacacttaaaataatactatattatagaaataaatcaacaaaaaattctatatttgggtatattttatgttgataattactcaaaataggatataatgagtattaggaggtgttattaatatgggtttttcacaaagattaaaagaactaaggactgaaaaaggtatttctaaagcaaccatggctaagaaactaaatattccttataccacttacaacaattacgagaatggtcgagagccaaaatttgatatattaaaaaaaatcgctcgtatattaaacgttactttaggtgaactgttggcagatgacgggtttaaaaattatttggatgatgttagagcggattgggcgcaccctgaaatgtgtagtctcaaacgatttgaagataatttaaatgctataaaatatactttaatcggtgacgaaagtgagggttatatatggctctctaatggtaaaaacacaatagaaattaccgaagatgaaattaatgagttaataaatgacgtagacgattatttattattcagaatcgaacagttaaagaaaaagaacgaagacagaaaagattattataaataaaaaaagcgcctcctacggacataggaaacgctgagcgtaaattaacatattggcgtacgtttatttacgctcctattatagcaaaaaatagcgtgtacgcaaactattttataaaggagtgaattattatgagtattagaaaaagagcaagtaagaaagctaaaaacggttacgtgtatgaagtatattttccatataaacaaaacgggataacatgtagatattctaagtccggatttaagaccaagaaagaggctcaggaacatgaggctttaatgttagctgagttaaaagagaatggatcaataaaaaaagaaataaaaaaatctttggaaaatgtctatcatgagtttttagaagtcgggagtgcccaatatcaaagtagtactatatacagtaccaagaaaaactaccattactttgaaaaggaattaggacaattaccaattgcaactatagactattcaatactgcaaaaatattttaacagtcgcagtgaatacggtattgaaaccaataaaaacatcaaaaaaaccatcagcagaattctaaactttgctataaaagtcgggtacatcaaaagcaacccacttaatcttgtaacggttacgggcattgaaaatcatctcgatcatgaaaaagtacttttatatgatgattttaaaaccattataaatgcattagataaagtggattttaaacgaaaggcatactctatcgctattcaaatcagttattatacagggcttagaatcagcgaagttttagccttggataaatctgattttgatttagacaacaatttaatttttataaataaaaagttactttataaagatttaaaaaaagaaaactacactacttctaatcaaatgaagtcaaaaacatctaaagctattataccattggccaatccattaaagcattctataattgaatggtttaaaaagaacccatatgaaaaggtcatatgcgatattgacggatactatataaatcccaatgtattatcactagatgtaaaaaatttagctaaaaatctaggtatatcgtttcattttcatatgttaagacacacatttgccacaaaccttgtaaacagtaatgtagatttaaaaactgcacaagaactaatgagacacagtaacatcaatacaaccatgagtatctatacccatgtaaatgatcagcataaaatcaacgtcataaataatgtttttgatataaaaagtgtcgaaaaagtgtcgaaaacaaacaacaaaataaaaacccttaactaaacactactaaagtcaagggtttcaagagattactaattatctctaattctctaatggtctcccctcacggtctcgaaccgtggaccctctgattaagagtgtgagttcgtaaatgatccaaacttcttatgtagcaagggttttggaatatttatttttattttgactactattttgactactttataaatatatagttcttaacacaataaaaaacacccaaattagcaggtgctttcttttatgatcctgcttaacttatcttttatctgctgtagttcttctacagcttttttaatgtctttttctttctttaaaatttctgctgttttgtttagttcgctagaaatatcttttaatcccttcattcttcttccctccttaaatattctacaacaaaattataaaatattcagacatatttttgcaaactaacgaggactgtaaagcggatttaaaggataaaaaaacatatactgcagaatttaaaagtgtattaaaaacctaggctataacacctaggtttttatcacttatcatgtctatcttctttttcttttcgctcttgcgtatcattttttcgtccataaataaatacccctacaagagttgcaattgttccaataataacagagagacctgttatatttttatctaacgctatcaatataaaacctccaatagtacaaactaatgcaattataaaaccaaaccattgccctcttttactattttcaacatctgataatatggcagatttttcgagaagttgcctatgttccgattgcttttcagccatggacaaaatcctatctgctgcacctggtaaaactctttcatactgttgaaaatcattaggatgtggtataggacctgagtatgaaacgcttgtaatttgttgtactaaaatttcccttttttcttctggtaatttattaatcgtttgaagaacattttctatttcattatcttttcctataatttcatcatttgatttatttgtttttctggttggcttttttgaagaagttggtatttgactatctctttggtcttgctgaagtttgtgtcttgtactcatctaacgcctctctcatgtcattccctataattttccaatcagatctaatagcttttaaatccgcctcagctaccgatcttgctgaattataaactttgccagtagcaccaatatttaaaatgctacctacgccctttaaaaaagaaggtcgagcaaataaaaaatcacttctatccatttcaaaacctccttaacctttcttttattttttttatataatttttgaggtttcaaaagtaacctcacagtcattataccacgaaatgaatttttttctagagtgatagagtatatttattgacaattacgaatctttctattttatatattttattaagtggcttatatataatataccaaaaattataaatttttagtccgtaattaatttttttcataattattataatatgggttaaaattatttactatttatgtgctgatttttttacatacaaaaaaaagcctagatcattttgacctaggcaatttttctatatatttattgtttacataatattgtttcttgtttggtgcttctataacactgtgggtagcaccaaatagtattaaaatatatttaacgtccaacaatctacatccctcaatatcctcagctccgtttattaattttacctccatattacattttagtaccttttaacaaccattcccacgtatttttaccaacgataccgtcttgtgttaaaccccgatttctttggaacacaataactgcattcttggtattctctccaaagattccatctgtagttaaattaaatccaactctattaagacgttcttggattaagcgggttacgttacctttagcaccttttttaactgtaggacaagcatttaaagttttaggtccttttataccatctactactaatcccgctccaaactgcgaatttagctctttctgcagacgtcttatccaattatccccgcttggctttggtgtaggtgtaggagcgggtactggttgcggttgtactgtttctacatcggtatccgtaattgctttataaaccgcctctgcgattgctgcagctcctactcttctgtaagtttcaacatcttctgcattatccacaaaacaacactcaattaacatactcttagccttagttttcttaacaacatacaatcctgtaccgtttttaactccacggttcgcaaatcctaaagcgctaatattggcacatacctctaatgcatcatcaaactgtctacccttgtatgtgtatgtttcaacaccatgcccttttccatcagattcgttaaaatggaaagagacaaagtagtctaagtcttgccgatttgccatttctacgactttctttagatattctgcttgtgtatttgctttgtctatcgtacagtcaataacctcatgtccgtttttaattaacagatcaacgaaagcatttcctacattacgtgtttctgtactttcgtttaaaatacttaccgcaccgctacctggtccatttaatgtgtggccataatttactccaattttcatattagttttcctcctataactcaattctttcatttttagctctgtaattatcggcaatttcccaatcatcacaagccatattactaacggtatataagatatcatcactattacgaatattaatagttttatcattgtaagtgtgcatgatgatttcgttatcttctagtacccaatatcctgtccaatgttttctttttattttatgtcctctttgaagacttataaatgcacttgcaaaattcatatatttatcctcctaacttaatacatttgttttcccattttttgtaagcatcaaaatacaactcatttttattaccgttaaaagtacattcgtaatacatgccatcagacaaagtagtacttaataatgctttgttgttttgcagtgttttacaattccaaacaacaaacacatcttcctctgtaatttgctttttatctgttttatctaaatgattgttagtgtacttaacaatctcttttttacataagtctaaaaatttacttgtatccattattctgtttcctccttatttactaatttatctgccacttccaacccttttgttaatatgttaggtacgttgtacccagcttctaccaaattctctacaatacttctaagctcatttattgctagtgaagccaatacaaaccaccctaataaagtagtaatccctaaatcaatccctaacgcatttccaatttcaataaacaaaactgatgctgaaaatgaaatcatgatcataatccaataacctagcttctttaaaactccctttaatcctttggcggagttttcttttttatttaatctggatttcatccaccctgtaatataatcaataacgttgaaaaataagaataacgcaaataaaatccaatgttctccaaaaataaacgttaaaaacgcaataacagcgcctataactgcattgtatgtatccatataatttaagttcatatttttttacctcttctttctggataagtttaatgcctttccaaggcaaattaaaaggacctggcggtccttgtttctattcttctactaatttccaaccctgtggataagttaatggatcccaaacacatccatctatttggcatatgtacttcttcccttggaacattactttattgcccgctttgtaagcattgtgcgcacctgtcggctgtacatacaaaggccactcctcctctggttctgttggttctgcaccttggccattttctaatcggcttaaccgaatatctaactgctggtaatattcccacaagttagcaatttgttgtgtattctctatgtaggaattttctgggattgcgttagaacgtgctaaattaaccagctcgtctcgttcttcttctgttagaatattttctacccataatttgtttattttggataagatatctactaattcgtaagaccccttatttaatacatcttttataacactatacattttttaccacctcttcctgtaaatttaaaacagttgcttctaatttttgttgtgctaacgccaaatctttaggatactgtgcattaatcgttggcttaacttcgccttcgataaaaatgtttgtaataggactgtatattctaagtgcttttaattcttctgccaattctggctcaacgccatttaaatcttttatagtgttagttgccgttaaaagatacacattattattttttaaaaaatctttaaagccttgtgcgctaacttctaataatttgtctttttgtatgtttatataatatgctatattccctataaattctttgtctgtcatatacagatactcaactgattggtcttgcgctcccataatatcaaataaattaatatctaatatttcataaagttgaaaacctttgattattgctctaaaacacacatgagtgtcagtttctttatttatcgaccatgaccatccagatatatcattttttttaattttttgagtatgcaacatttcattgatatctataatatcgtatctattttgtgttggaattgcatttaatgtttgttgtaaagtgtattctatttcagtttttttaaactcttcaaaacttgtaacattttctccaagttctaattgcaatttttctggcaaatagcttccataaaaattaacataataacaatttgatggagttgtaactacattctgttcgctatagttaagataatttttagttttatcgtaaaataaaaaagttatattgtcagcattgctagaaatcttttgatttggatatacattaataaattggtttgtatttctactaataccaaacatagttaccccttgtggtttacctgtgcttatgttataggcacctattgttttatcaccatcaaacaaatttttgccaatacacttaatatgaaccttatcaaccccaataatttccttgtctttttttgttgtattccctattattttagttacttttaaattgccttctaaacaatcatctaaaagtacatgctctactatttctatatctgtatatggcttatccattttatctcgcagtaagtaatctacttcctgctgtgtatagacattttctggaaaagcgctacccggtacgacattaccatcttcgtctaccaccattgccttaccagcattttcgacaccttggttaatatttaatttttcatcaataacctcatccaatcctttaccatctgcacattcaacatcttgtgcatccagtaatttaaaattaccgctatttttaggttttaatttggctataatttctacaaaactactcatttaaccacctcctacgacacaactactgttgtatttcctaagttagaattactggatttatatacatcataattttctgcataacctgaaccatttataaaattaaatgttcctaatttaccaaaaccaccctcgaatccaccaattttaaatgttggtgttccatatctgctaggaacagcataataaatatatttactttctcccgcgtttacagtaaacgccttagctttactagattgtagtgttttagttaaagataagataaattgatttgtaatactatctatctctaaatcgtctccaattccataatacaccccatttaaaaaagtgatggaggttgttttagtagcaaccgcattgcgctcatctgttgcttttaatgtatatgttttgttagatgtaatattttgtccacttaacgttttagtttttaaattaacatctaaagtttcgttatctaatgttaatgctttaggaactttgttgtagttccaattcaacacaacatctgtaatagttgttcccatttccacagtatttttgttatttgtaagagatgttatagaaattggtatatacattaaatcacctaatttttcatatacatcatctaaagccaaatcgacattggagttattataactaatgttttcagcggttaattgtatatcatcttttacgataatattaccttctccgtctgtccctaacagcttattagaattttcttcgcctaaatttttatccatttttttgtcaatttcaaaatttacatttgttattttttcatttaatgttttattagcatcttctacattagaattaaaaatctctactttagaagtgtaatcgccattaaagctatttacttttcctgcataatttgcgttaaatgcattagttttctctgtaacactgtctaaatgttctttagctttattagcattagttaaagaaatagaagcactgtcgcttgcgcttgtagcactttctaatgctcttttggcattattggagctttctgttgctttttcttttactagctctacatcttcttttatagcttctcttgcagcactggaaactacacttatccacgtttccttttcctctggcaatattgcattactgtttccgaaagcaattttaacgtagtactctacaaaacctagatgcactatcttgccgtctggataatttaacgcgaaagaaaaatatacacttccttctttagaaaaaacatcctgatttaatgtaaaaataccatcttcttttatattaagtagatactcttcgcctttttgtcgtttgtaccagccagttaaaatagcatctgcatagttttcgtctctaacgaactgcattttcaaatctgcactgtattggaatgtcggcacaatatcttctaatgtaataatctggccatcttgtatgatttttgcaattatcattaactcacctccttatgacacataaaaatagctgtagttaattcttattgctatatttaattttctatcgaaaagtaccagtggatctcctaatcctttagagctgtctccactccacacagaaccttctatatgtgctaatccaccatctccaccagcgcttccatccccgtttatgtaaacaattcctaatttagttctatccgctatagtaataccgtattcgtcgttaaacaaatttactatatctgcccaggtgtggactttagcgctggaatcgctaggattaattatttttgttccacttaccatatacaactgctttaaaggcggtatcctttttccttccacctgtaaagcaccgccaacatcaggatcatagaaggcaccaaaagccacaccaccattgccaaatgccatttgtgggataccgctggctaagatcgtagctttttctgtatttgctaacttatctgtagctataattttaaaatcatagttatttgctacatcaaagccattagcctccaagtctcctttgatttcatattctccttcaaattcgtccgaacgcaggacctgcggtgtaataatagtagatccctgtatccatgtgctggctccctgctctttataataatactgtgctgttaaactgttgtttaattttccaaaattattattccagaaaattcctttgtaacttagagtgacattagaacccataccaccttgggaacgacttaaagacaatcctgtaattacaggcggtgtatactgcttataactgcttatgtttaatatcttctctacagtatttcctctactgtcttctacataaactttaattatactgtcacttacattttctaaattaaacaccccagaagaagaactgcttgtaatcttatctccaactattactttatactgcttaatcgttgcttcctttactggcgtagcttctggtactgtaacagtaatattgctatacccctttataactgttgcattgctaactaaatctaaatgatttgtactctcccatgttggaatacctgctattggcattggatccttgataataaaggttctatcatggtagctcgcccatgtctgcccattagaatacaatccaatacgaatagtacagctattgcctttacatgcctgtcttaactgtttacgttctgcttctgttaaagaccatgtatatcttccgccggtacctctaaaagtgcgttcgcataaatgaggtccatttggatttggctcgagccatgcttttaattcccagtttgcaggattagtataatcaaaccatgggttttcttcgtcattaaagctagatggagaatttgtaatgctggcctgtctaggaatagatggaagcacccatgttgtcgatacatcttcattcgtactgctagagtagatagctgcaataatatgggcgctaaaactagcattaccattagcatcgtggtaaatgtctttatacccactatacaaatcacctttgtaacgtttggttctactgttactgtttacaataacatcacccgcagcatcacagtaatcacgatgatggtaatagtaagaagatgacccaccaacaacagttaccctttgataaatcgttgatttattagcttgaatatcctgactgactaattgccatgcatattccaggtatcgtccctgatatccgcctccgcctaacaatccactattggccattgtctattacctccacttcatctggatttatacgatttattactgtctgcccgttaatatcctgtataagcagatttactattgtcgctttatttttcaccacaatagaattagtaactattccctcatcatcaaaatacgctatgtactctccttgtttgttcatgaatcctataatatctgcatttgcaacaaacactacatctgttccactgctggatatacgaataccacgcccgatttggaccgtatcggaccatgtctcgtttgggtttaaggtccattccatagctgcatcacctttgtttagcataagattaatgattggacaggcattatctgtatcacattcaaatatgatcgttatatagccatctgttacttcaaacgtatatttaaattctgtgaaatcattattgcttaaaataaattcatttccattaataaagaacttaacattagctaaattaaccagttttttataaacaaaagacaaagtataagtaccatttgcaacacttatttgctgttttaaaatcccattttttagtagcagagcatatccgtactggtttctagagcgggtctctacggtactgtcaatgttataatcaccttcccaggaaccatcattaaaacagccgatactatctctgataagattgtttccgctggttgtttttatggtgtttgttataccatccaagcctagaatcatattttctactgtttcttttactgtcttttcttcatcattaattattactgtagaatccttgataagaccttctattttgccctgttccatacttaaggatgtctcaaggctagaaatactcgtatttatattttcaaatttaccagtataatcacttgcactaatccatttctcaccatcgtatatttttaaaatatttggttgatatgaagtatcaagccacttcatatctttgatagcattttctggttcagaatcactaacaattacacccgttgttgcatctaactttacttcaatatcttttatagaagcttttatctcaccgtctattttattaaccatcagttccgtttgacggaccttattttctatacttgatgcaatattataatttatttgacttttacttaatgcaggtgttgaaaaattgctttttattccgccagtatactcaagtgtgtggtttaatacataggcattaaaataactttcgttttctacttgtatattaattatatcccctggatccaaatgaaaataacctggcatacttgctacatacggcttatatccaaatccttttaccctgttccatatagcagttctcgaattgtatctatctatatctaaaaatggattattacttatctttaactctgttaaaccatttagttcaacactctcttcatcctgaatataaacattatcgttttgtggctctctagctaaaactaacgaattaattggtccatattcgacttcaagagttggatacgtatattgattatctaaaggcacagtaaaatcaactttattaaaccatttaaactcaagttcattattgcgatttattgtcgcaaatgtacaacatgcttgagcaactgctataataacatccgcgcaagttgcgttataaccaaaaaagatttctgatggaacagttaaatttttattaggaatatcagttttagccaattctacaccggattgattgcatgcttcctgtgctgcaagaaatggtgttgtaggataacttaattttgtagtgtcgaatgctctattaaaaagcattttattatccatgaacttatattcggtatcactaattttttcatagatattcatggtacccattgggacattttcgcctgtcccatttgctaattggacactaaaaaataaatcaaaagactcgttttctaattgtaacgagtcttgtttatttacttttaaagtaccactctttgcaataaatgttccaataaaagcatctgtttcagaattgtaaatattcatatcaaatgtacatttctgaatactatatgtatttccgtttacctttatatatgcattaatataccgagcattatttaatatagctgatttaaaatcatcactcacattatacatcagtcatacctcgcatttgaattcaaaacaaactctaaagattgataataatccattatccctgtcattctgtttttctttgggtcaacacaataacagtcaatagttttataggtatcagtttcactgtctagaaatctaacattaatattaggatttttaagaatatttaatatttcacgcactacacttttttcagttactcctaattttactgtaatactcattactctccctagaatatctctattcatttgaagtgtcggtgatcttccagaattttcaccatcctggatagaaggaagatcatcatattcaacaatgttttttatctctacattatttaaataaagcagtggtttatatgccatatcttaacctcctatcatttgacgctccttcttagcgctttctaataaaattgataatttcttaatatctacatctactttgataaccatattcttgactaattcaataagttctctaatcagttcaatcaaagtatccattttttcagcgttaccagtttctttttgcatcttcaatgctgtatcaatcatatcaagcattttattttcaggtgcaacaatttcaccatatcttttattgtcaccaatcatggccagttgtggttgatttggtttaacatacccgccttgtgcgagttttggaatttggggtacaggtaaagggtttttatcccataatcctttaaatggttttccaataataggaatatcaaaattcctaatatcattcaatatcccatttatagttttaaatgggaaagcaattactttatttattccatcaattattacatttactatatttttaaaaacatctgcaattcctccgacaattccgtcaaatatttttccaccgcttgtaaaaaatcctaaaattttatcccatgtattttttacaaaatcttttaacccgttccacattttttcccaaataccttttattccgcctagaacatcgtcaatccctttttttaaattatcgagtgcttttcctgctacatcacataatccatcccaaatacctccaaaaaaatctgaaataccaccccaaacagtattccatatagatttaataccactaagaactgtatcaattacagtttttattgtttctaaaacagtttttactatattggccataaaattccaaataccttgtaagatgccttttattccttcccaagctttgctccaattcccggtaaatacacctgttaagaagtcacagataccgctcaatatttccataacagattttattgtgttagaaataaatttaacgaataacttgactgcatcccaaactctttggattacatccgctactacaggagctaaagtatttatcagccactctataagtggttttaaaaccgcatcaaacacagttccaaataactctgcaaatttaccaaaaaactcaactatactgttaattgcaggttgaatataatctttccacattgcagaaaaatcatcagctatagcattaactactggagcgatattagagttataggcatcaagtacggtgcttacaatacttgttaatccctgctttattttatcaaatgccggttttacatattcatcatatgtttgcccgataacgccaaaagtttcattcacaccatcagctatagttctggttattgtttcgattggctttagcatttcttctaaggtggtttttattttatctttatttgcaattataggagcagtcaaagtatctataatatcttgtcctaattttcctattaaagttattgtccccatggctccgtttactactgcttctattaaattagctcctatattgatcgctgttggtcctgcaaacacactagctatatctgcaacagcagtagaaaaattccctattatatagcttgttctagttccgatgttaaaccactgtaatactgttgtttttatacgatcctcattattatttaaatatgtagccacactccctacaaataaggtagcaattgtagttccaatagaagctatagaaccggttaattgtcctaatgtcatagcggtttgatctacccataattttgcagcattagcaacctgcgggttaataaaaatgtactctaaactatcaccaattgaaaatatataattttttatacgttcaaaatctttgaaagaatcaccgaagcctattttaaatccttttaaaaagatttctgataatcttttaaattcattaacaataccggctaacatgttattaaaaacattcgcttgtttagaagcttctggaaatcctaccgcatcagcaacacttccaccagttccactattgctagatccgtcaccagaatcactggaatcatttccaaatgatagcttattaattgtatcaactttagtaaaagctctttgaatctttttagcagctttttcaccgctctttcctgcattttttaatccgtcacttaaatttccagcgttgtcagtagcagttcctaagtcactggcaacttcctgcaccgcactgtttccacctccgctgtcattagaaccccctgttaagaattccatcatattagcaaaagaatctgctaaagactgcaaatttgctaaaacccagtttattccttttacaataggcgtgaatactgcaataaatcccttacctagacttgcttttaaactgtcaaagcgtaaaccaagaattctagtttgattggcccatgaatcctgtgtcttaataaaatcacctgtagccatagataactgatcctgaacaaacgcataccgcaatgctactttttcctgctcagacattttagcagttgttttaccgtaaccgtttgccaaagcatactgatcaagtgccgcctgagtcattacaacacctaaatcttttaatgtctcagtctcaccagtgaatacacttttgatttttgtataagcctcagtcggatctaaattatagaatgatgcaacatcacccgctaaacccgttagagtcttagacatttcaagtgcttctttttcagtaaatccaaacgagttagacatagcaccaaaagtgcccatgaatttcttagccatagtctcactaaggccaaaagattccattgcacttttagcaaaatcatcagcgcttgcagacatacttggaaatgcagtatcaacaacattttgtacctctgttaaatcagaacctaattgcagacaagaacccataaaatcagtaacagctttaattgaaaaagctgcagctgccattttcccaattcttttaaaagacgaattaaaagatgattcaagcatattggaacctgaatcacctaacttttttatttgacctttataatttttgccattgatgacaatatcaacaccaatggcacctacactatttggcttccgcgtcacctcctgctagttccttaaacatattcttgaacatttcgattgcatcttctgcttcttttttgtccatattcttagctttacgattacgccattcactgcgtatacgtttctgctcagtggtaaaattcttgataatatttttatcttcctcactgcgaattcgtacaatatttcctaacggtgtatctggcattattcctgataaataggaacaaaattcatcccatggcatatcatctatctgtcttaaacgaataccatactgtttaaaaaaactggcttctattaaagaccagtcatcaataatatcataataatcattactgctattgttgcttttgaaatcgtttttctacatcctcaagttcttcatcgtttaccgctgccattagggcaaaagcaatcgtctcgtatgctttaaagtttaatttcatatcttctagctttttaaactgcctttttcctaataaaatttctatcattttatctgttctttcaatgctatttaatgattcatctttcatcacttgattcataattagaatatttgtcttttcatcattgatagtaaattccgttccacctatcttgatagatggtttttcattgctaagtttgttcgttaaatctatatgttttgccattcataggtcctccttgtaattttataaaaataaaagagggaatatatccctctaagctgcttctgtaaatgttggctttccatttgacatgacttcaaactctaatggacctacacctgtagagtcaccagcaccaatattcgttacattgatgattgcttcagcaatttctaatttagagccatctggaaaagtccattggaacggtgcttctgcatctcttccatttttgttatacatagccgcaacttgatcatttcctgtatcaccgatatttctttttcctgttacagtaatagtcaatgcctttgctgtcatcaatctacgtacccaaccttctgtttcaaatggtgtccattcttcaacaccattatcaaagctgactgaaaaagattccatatctgcgatggaattataagttgtagtttcgcctgttttactgccaattccaaactgattttcatagcatggatatactcctgttcttcctgccatatttaaatcctcctatctttcataataaaaaactgcattgattaccatttcatagacccccttgtcatcagtgtccacgtttactggtccgcattcaagcagttcaatgtatttaattttaatatcaccaatcataatattggttttagcttccatttgttcatataaccgattagaagcctcctcggttttatcctgattcttatcccagtgaattaaaaaagttactgctttttgtctatatgaggtattagccagaccgcctaaagcaacgtaaggtgcaagtgcttttttagcattatagacgccaatagatttatcattcttgttatcgagtttaccgatatagaaatgttcagcaccagtatcaagggtttttacccagtcctttatctgttttaaagataatatcattttaatctccttttcaacagcttagaaaatgcatcaggaacaaaattttcatactgaccgcccttcatccacggttcaagccatttgccgccagcaaagctattattgattgtctggaagtcatattctggatgataataaaggcgtcttgcttgtggagaagtggtaatcaaacttacagagccttgtttgctgttagaatagtccacaaaagtgttttcgttttgcataattcccgtgtcaaaaggcattacttcagcattaacaacttcggtatgcagtgcttcacctgtttgttctagtgcaatttggatatctttatcgaattcttttatcttagctttataaaatttaaaagccattactcaaactccagcaatgtatagtttaccgttccatcaggattgcgggccttggtccctttgtatagttttcttttcaccccaaacacttcagcttcaccaccgctaatcaccgctagataaggcgcaatatcaccattaaaataggctttaccgctcagcgtgataagtttctgttcagcagtaagaaccttataggcattatcctgaaagttacatttaaaatcatcctctaaaacaataactggttcaccctcttcagacagtcccacatcttctatctttatatgaatcggtgtaatacaaatcttatcaggtactaagctcggccatttcaataataaaacgtcctaacacatagacccgtttgagccagaatattataaagatccaatgggatcgctatcccatttacaatctttacattccagctttcaccaaaattcatactcacaccatttattgcatatgaagataatacactctgcagcacttcactgttttcatactcgaactctgccaatcctgcaattacttcttttacagtttctttcctaaaatcagttaacgcatcaatattagtaatcctgttaaacgttaatgtatcgatatgccgactagcctgtctcaagcattttgttatttctgaattaggaattttgctactgggacttagtctgtaaaattcctcaacaccaagatgtggggtatacataagtatcacctactctcgttttccttgattaatgcaacgatcgtatcaatagtcatatcttctgttgcttcaagccccatctcttttgctttagcgatcaactcgcctttgttcatctttgacagcgattttcctttgtggtttccagatttttctagttctacaatctttgcttttaattcttcattttcttttttaagcacaacatatttactgtactcaatctttttcaaaggtgaatattctaaaagactcccctcgtcatcgtagatatcatagccatcagctagataactttttttttgagcttctacaatacgataaaccttattgtctttttttgctttcatctaaatacctcctatgcactttctgcttcagcgtgaatgatacatccttctgctaacataccgtctaaagcaaacgttccattgaaacgtctgttttgatataaatagttatctgctgtacgtgaatcatgaccaggtgtaaatacattaatataagaatatttaactcgtgatacctgtgcctctggatcgattaagatataattaatttgtttacctgatgcatcaacttgatatccttcagtaaaatcaaatgcagtttttaatctacttgatggtactgttttgatttctttaatatcatccagtgaatggattctacgatcaagtccattagaaccgctaccaacatttaaagttctttgaatgccttcagcattttttaagattctacggtatgcaggtgtacaatataaaatcactctttccaacggaactcccgcttcttccatagcttctagattagcatcaaaatcagctaatacattagcttcagttaaagcaactgttttaatttgtgcccctacacgtttagcttcactgtataactttgaatatgtataacagtctaattctggcatagcctgtctacgttcaaaacgtgcctgaatatttgcgatagatataatttgattagtttcatctacatccattggatcaataaaaaattcaatatctctatcatgatctaatgatttttcctcccaatcgttaccataagttcctgtattaaaacctaaagtagctcgattatgatctttatatccgcttactgttacttttggtaacttgattgtttttgctccacggatctggatgtctggatttgagttgaataacgctgacgatgtcaagtcgtgatcatacatttccaaaatcttagtagcaaactgtgttacataatttaatgctgccatttattggccctccttcatttttttctattttttaattccaaaaatactgtttagagcttcttctactccatgtgtatttccgttattgcctggtcccccaatctgttgaaatccattttggccaccattagatccacctgattttatttcaggaaacgccttaacgatattttcaatttcagttttaaaaacatcttcttcagcaaggctgccatcttctttagcaagtttagatttatctactaatttagctaaaaacggaacttttgaagcatcaataccttgagctaaagctagctcattcatttttgagctaatattcatgtttagaatttgtgctttaagcgctgcattttcctgtatagcagtttgtgcttgtaacgctgcctgattttccttttcagttttctgctgtttaaataactctgccgcctgatttaattcctcaccagtcaatccttgagtttttaaataaccctttaaagcactttcttctgtggctgatgtccttttagagattacatcagctattttttcataatcaatttctactgttgttgaggtacttggtgatgctggaggcgtaccttcccccgctcctccatcccctccttcagcgaataattgaatgtttaatggatacttaaataattttgtcacgttgttttcctcctattttacgtgtggcacacgaaatatcccgttttaggtgtggcgcaccatacatacagttttatgtcatgttgaggacataataaaaacgacttacttttcagcagccgctttatcaactttattaacttttatttcttttaccaaacctaaaccaatcagatgtttgcctcttttatcttcaacatcaagggtttcatcttttttgatgtactcttgctcaactctgtcgaaatactcatgaacagtgcattttactttcaaactaccacctccttaatagatttcatttttcttctcttttcaatcctttaacaaattccaacaaatcagggatactatcatcattgctggcaatatcaatttcatgttctctatgttcctcatctccatgaaaaataatatgaccatctttattttttagcaatttatacttatcttttttttcttccatactgccaccccatactttttgataatgtttttaaaatctgatgttttgcctccgaataagccatgccagtatctttagccagatttataacttggttttcagcagccctcttaaagtctactatttcatcattgttttcaaatctaattctactaccttttggtgtagaaaaaaagtattgaaaattatcttcggtttgaacaatggaaattcctattggatccacaatgttatgagtaactatatcgctgaatgaaaaaggattattactaggatgggtgtgtaatgaaaataatgtattatcttttgccgaatcgataacttttaattgttcttttgtgggttcggaatattttttgctttttgaagaactgaatccacctaatattttgccagtattgatatcagcaaaagccagacattccgaacctgtctgtttgcttcgtgacactaattcatcaaaatttttatctattttttcctgaacttctttagatagaattaatccctttggtaaatcatcagatcttttaaatgaattgagaatatctaaatcaccgttatcttcaaacaatatttctttttgtttagcaatactattaattctaactttttctcttgcatagtttctatgcatttcagggtgtttctcgataagctgacgttgtctagcctgccattcaagacgctttctcttatatttggattgattatccctatcaagtgaattattctctaaacgcttatattttcttatctggcgttcattatagcgctgtgtagcaaccaaatcactgttttcacgagttttctttacatcagcagctttagggattgtggttatcccttcaaaataagttgtgataatatgcttgcagttagggtggaataatccaccagcaatcgctgtgcttaataacgggtatccggttttctcagcttcttcagcagtaccacctgaatagacatcatctatatagactttaccctgccacggcaagcaagtaggactacatgcaccatatcgactgacaagaacagtatgaataccccactcatctcttttagtaccctcaccgacaaggtatgctttcttattggcgttacgaattgccatttctgcataagtatcaataccaactctacggccattcttgtactcaatacaattaatacccttcgctaaaaagtcttttgtggccatatcaatcgcttgatcaaccgttattgttccactatttgcaaaaacttgagctctgtaaatagttttgcgatattcgtcatcagccattctaagcattgcagaagacgctttttttagatctttttcagttgcattaataattgcctttaacttcctatcgttgatactaaaaaaagtactactaatcgcttttgtaggctttcttatactaaatccatttttaatagcttttaatatctcagcttcctgttttgtgtttgctgactgaacagttctttttagaagctcctcaagttttagtttgaaagtattgtaattcttatttacatactttttatttgaacgcttaaagtcctctaaagcttcaagttggagcacttgccacgcttcccagttaaacccttcttcttgttcccatttttcatgtcgggctaaatttctggtcattgaagtaatcagatattcctgcatttcattaaaaatacggctgatatcataatcgttcatgaccaaacctcctaaactaattttctaacatagtagcacttatagccttttctattccaccgctggacctcgtcaagcagttctacaggattttcaaatccatctttacggcattcaaaaacaccttttttttcaataccgaggattatattttttcttttaaatttcttcttaagctcacgtacaaaacctttaaactcattttttcccattttatatgtatgaccgttaattaacactatcatctatatcttcctccagatcatctacatcaggaacattcattccaggttcttctatatcatcagcaattccctgttgttcttttaaacgtctgacttcttcgtctttccattctttatcttttgaatcgccatacatttcctcaactgctgcttcaatcgacatcacgggttgtccaggtcttgcttttgatactgtctctacaaccgcctcaaagcttgggttagcatattcaccaaatgatacttctatatcttcagatttgcgaggatcctttttgttgaaaatatccatagcctgcaatgtggtattaactacatcaggaatcaccttttctaatgcctccacaatcttgccacgtgtataaagcgttgttttttctttctcacgttgagcctcagcgttatctaactttttagtatcaattcccaaagtactcggacttataagcccctgaagacactgatcaagaaaagtcgtatatgactgaatataactttcaactggtatgtcaggttgaactacttcaattttatcttttgcatcttcttttccagtatcaccagtagcaatgaatctattgtcaaagtcatttgctttcaaaaccttaccggttgttgggtctcttggaaggagtccatcaggaatatatttagtagctctaccagatcttactgcatcggcccattgtgatataacttcatccaaagcatcaaaactgtcatacttattttcaaaaatagatttaccacgatgtacccactttgctgatctgtaaatcttaaaaggaactgccaaattaacagttcctcggcttataacctcgccatctttttccttataacccgaaaaagcaaaatcagctacattttccatttgagcaattgagtacaaatcaacctctttaccagaacgggcctctaccagcttatttttaatatagccataaccatatgtttcatagtgaatatattttttctgattagcctcataaacgttcttaaaaacagtctcaatgtaacggcctcttttgtaaacaaactcacactgatcagctgaataaaactcaataattggatattcgcttattgatgtatcgaaactgattttaaaagcaccatcaccctgagataaagtatcaataaccgcctgttcaataacatcataaaaattattatcgtttgatatattatcccagtcaattgaactgctgtctggtgtaatcccatttaaatcacgaataacaatacctgataatgtatttatcattaacgcaggcaatccagaatgaatttttctaatttttatttctggaacagcactccaaaaagtcgaattattatcttctatctgtttatagaattgactcaactcatacggatcaccacgataccatatcctattcctaattgtgtttgtatcaaagttatacagctcagtaatattaaactgtgtattttgtgcctcgtttaaatcaagccatcctttaatcatattcttgattgcacctcctattctactcacttaaatcactccttatcaatcaatggattcactgtatttatttcatgcttgtatggtaaccaaccatattggctaccattaatcgtatgatcatttttatcttcaggtgcgtattcatcatctttccatgaataaactcccagttcttttatatgttctttgcaatgatcaactaccaaataatttaaattctttatccagtcctgcattaattcgatacgtgttattatcaaagtttttttccatgcattagcaagattaaaaatagatccttttaaccgtttgaattttttccactccatcatcgtagcctgatcggcattatcaagaaaactgtttctagcaaaaccccatttacgcttatttctttcaagaaacgctatcaggttcataatattatcacttggagctatgggtttttcaatcatcttattgttgtaaacttcttcatccagaacaatacacttaccacattcagtaataccgataaatatgtaagtaatggtatctggactgttttgtgaatatgcagtatcaataccgcatgtataacgtttaaatctgtactgtctagcctgttcctcagtaaggatattgtccttaccaaactgagcaaacacaagtccagtagccttaccgcgcagtccctggatcttattcttaaacattttagttcctggaggtactgaatcaatcttgatttgaatctgttcctgagtaagagcagcgttatcgtaaaaagtaaaataccagtgaatccagccttttactggaggctcatttaattcttccagtaactctttgggatagtccttgatatatcttttcaatggtctgctgcgattgataaattctttatatacatcaagcgatggatcatcagggtttgaagtagtcatcatgtattcacaacggtgagttatctcacgcataaactccatgtcagcaatattgacctcatcgacatacacgcatccaacctgacctcctaacaccttttgccatcgccttttattgtcgtatccgcatatataaataatcttagttcctcttggtgtcctatactcaatatgtggcaatccaattttcccatgacctcctggccagtattccgccaagccatccatttcatcaattaaaccatgctcagcattgataacatttttttcaacagttcctttatcagctcctgcaatgatatgaaacttgatatcactgtctgctacccgcaacataaatttaataacaccaactgttgttttacctgcagcggttgttccttctaaatactccctaggagctcttacggttaaaaaatcagcgaattttggacttagaacaagtgacattaaatatcatcatcctttaaaggtttcatctgctttaaaagttcattgattgcatcaagtttcttttcctcaccttcatttttaacttcaagtttatcattgtacattcccagatgtctgttaagcatatcaagactctttgtcttgtcataaaatttaacttctctttcaactatctcaccatcttcggtaggaattgttttaacctttacactggctatcgctgccagatcatcaagtgaggcttcatcaatgactgttgcttcattaagactgattacatcagcaggattaacaaatgcaattcttgcaatttctcgaaggactctatcctgagtaataccagtcctcttagaacgttctgccatagctctatcaatggcatctttaacatgaccaccctttaacatcctgcaagcttgctcagctgcggtttttggactgaatcccgcccgtatagcggcctgagttccgtttagatcaattaaatattcttctacaaatctttcctgcttctctgtcatagtgacacctcactttctaaaatcaaaaaagcgaaccaatgtccgctgtttatatttatttggttgcaggaggtggaattgcaccaccgcctccgggggaagatcccgacaagctgctactgctctatcctgccatccacataaagcgacaccatagaaacaaattatatttatacaaaggggaggcgttattgactagctggtgccgctttatctaaaaactcttcctttttaacgccttggcgagtcgagcaatggcgaaaataaaaaagctctgagaattgagcttttttactaatttttataatcaagaaagggacgagaaatgaaaaattatcttgggattgtgtgttccttaaccaaaagaccacattaacataataacacatatagaatagcaatgtgtgccatttactgccaatctttctataaattaatttgccttattcccagactatggtaattgcgaatctgagaataactatagctcattaatttagcaatttcttggtatgtcttaaattgcaaatatttataaccaatcactgatcttgcttttaaatctggaatcgcattgatactgtcttcgatttctcccatttcgttcatcaaaccggtcttttccgctagatactgctcaatagacttatgaccgcctgatgacggaccatacttaatcgccttgattcccagcatctgattatctatgaatatgatcctatcgtatttatctcgataggatttcaaatactgaactttttcattgtaatccatcatcttcctcctatttctttttgcttctttttttatcaaaataaaccgcatagcaaatcaacattgctaattcgcagagtagggttgcacctactccgcaccagaactcacttatgtacattaattttcactcctttcatgcataaccgcacattttaccaactaaatatatttcgtgtttacagtagttgttataacgataaattttaccgcataacggactttcaacgataattaagtagtgcccgtctttatttaaaccgtctaataattcctttaaagaaaaatacggttgttctataagtagctcattatttttaactacatcatctttggataaatcaattattaaaacactttccattccaggtggactaattaatatgtccgctggattaatttctaacctttccattttttaatagctccttgttttcatatatgttttccaattacttctatttctttatcgtgcttatttacattcaccttcaacggacaccagcggggaaatctgcaaccaagctgatactcgacacattcttttactaacctgggccctaaaatattatctggatgacagcagtaatagccgtttactttgcttttggattttttataatctatgtgcttacatgtattacatttcactgcttttcctcctgtattcccttctgatatttattcatacgatatcacctcatgcttgtagaaacgattttcttcgaattttttaaatataactgggtggctgaaaacaaataaagtcttaccactttcggattcatctaatttaaatatttcgaaatattcttttactatgttatcccacacccacatatcctcttttaaatcttcgaattttaaaggcttattatcatctttaccccattgtagcaataatttcatgtgttgtttttctaactcgttatgttttctaattaattcaaaatattcatctattaatcgttctattttacatagagccctataatcccctttatacaccggcttttcacgtaaataatatggtttagcagtaatcccgtgtttcatatgccaccttgaataagcacctttgattagatgctctaatgattgttcacagtcttctttagtcaaattcattttatccaccccaattcttcgcattgcttattgattgcttttaatgtatccatatatattatcgtattgccttgtggatgattgtcattatattcttcatattcttctataataattcgttttcccacctcgacaaaagtaagcattgtgatatacccaccatcatcttttttataagataagcatggttgatttttaattaattcaaatcctaattcctcaaacatttcttcagcgttcatcttcaccaccccatatctctgttctatacatataaatcttaacttttcttaacgtgtttacctccaagatatctatcttcattatctgcaatatgcagatacttttctaaacttagcccagaagctttccagcgaaagtaaccgtatttagtctgtcggcaattggcttgcctataaacacaagttttaatgctctgggcttttttatatttttttaaatcttcttgggttatttgcatcatttatcttttgcaactacgcagcatgccaaaatttcatcaatttcccacaactcaccttttttgataaatttaaaggtaccatagcaggaacaatctggcttttctgccgtcggccaatagataccctgttcaaatttgggattcaatttatagaagaaaacgaaatcgtttttatcttcttttgctaaatagcgataccccttagaatacaccaattttagggtttcgtgttcatacagcgtaagcggtatcttatccacatattcgtctaataaacttagtaacacttcattaatgttctcacattttgagttaaatattttttcatttattttgcaaaagagtactgggtaatctgtctctttttgtattaggtttattaattcatctttatatttttcaattactaacattttttatcctcacatttctttcaaattgtctacaatactatttcatcaaatatgccacatcttattagaactttaaatatttcttctagcaccggtacgcaaatactattgccagctaaatatgatatttgtttatctgttataccattattttttattctaaaatagtcattgtcctcaaaccccattaacctaaaatgctcctttgcagttaataatcttaattgattattataataaattgcttgtcttggttgagttgttaatgtcttagctactttgtttccaactctacctctacgtgttttagagttaggaaactcaacattgatagtatcaaattcgtttacgactttatatcctaactttgtagcttccctaacgcaaaggtgatcatcttttttaaagaatatacttaattcattgtctgtaagtctgtaatcatcaaattctacatcataatctaaataatatcgtatatctttacttaatggttttggctcaggaaacttaaattcattgtcctctaataaactaacaacatataatctatctcttgcttgtggaatgttataatcactggctttaaggattgctagatggtttgtgtatccaagcctagatgtttcatttaaataatgttctaaatggtgtttatggcgttttgacgcaagattaggaacattttcccataacaaaactttaggaagcctgttaagctctttttcaattatctctaatgttctttcaaaaagtatagaccgccccgtttttatgttgttaagaccgtttttagaaaaatcttgacaaggtgaaccatgcactagaatatcgacatctaaattccaagtttttatatcttgtggcttgtgattattgttaaaaatactatcgtacgcttgtaccgcacatggcaatatttctacataatctatactttttatatctatacctagattttctaacgcttttctaggggctcctattcctccaaaaagttctaacagtttaatcaaaccaaatgcgcccctaaatctaaacgtttcttagttcctaatgttacatacccatgtttgcagtaatcttcaattacgcaagttatctctacatggataaatcgccctgtataatcttttttatattcttctaggcataaaatgtcccccacttgaaaatcacgatcgttttctctaatttcaaaatttttcataccttgaagttgtaaatcaaagtatcttggtttggtttttaaattaataattttcatgtatatgctcctttattcaaattgctttaaaaattttacatcttcatcactcagatttacatctaatttatataaattttcggtctgcccttgataatctgtttttaaattgttataaagtgccatcttaaaataagaaaaccgattatttattgttttattttccatctgttttaatacatattcactttttatagctacatcaactgcatcgtacatttctaaacagtctgtaataacatcatcgaatattgtaatttctttatcgcttattaaactgttattaaacaatctttctgttatgtaatgcacattactgttggctatatcttctactgtttcttggttaaatggtatggtttttattggttgggtagttggtttgatatctttataaacatttttaaacccatacccaacaacagttattactgtgtatttgttggttgtttcgatggttatatctccacttttttctaggttagctattgcagttctaattggttgccttgttaatgttaatgctttcatcaattttgctaccgttgtgacgaaactaccacgtttaactgtaatacctttccattctctatcttcccaattagcaactaattggcaatgtatgtatagagctaaacttggtgcatggctataccactttctttgcattatgtttctgtctatattaacccagccattgcttttatccattgtttacctcctttaggaaagaaagagtaacaactactctttctttagatcaatcataattggctctttcggtggttctatctcaccgtttaaatttatttgcccagttaatacacttgatggttcttgtaacacaaaccctaatacctctccattttcatcacgtttgatttgattataaacgtgaatatcctcggtttttttaggacttaacttagatgttatagttggtttgatatccatttctttcttatcgttttttggtgtaaatttaagttttaacgttatttcacgtgctttatcgtcggttgctacatcagctagattaaccatcaccttggctaattcacaatctaaatctctaactatggaaccgttatttatatctaatatacttcttgtgtacttactttccatttttctgctccttataatgctaatacaacttgtcttctaatttcttctggtagttcagcctctaaaaactgcttgattaatctttgtacttctttttcaaaatatcctttatctgcaacgaacaaagcgcatcttccactatcgtctacacgcaaattaaacttacgttccacttggattaattcgggatatgttgctacaggaattaatttaacaattggattgatagtaacctgtcccgctccgcctgtgaaagcatcgctttctacaatgatttttttaccaattccattatcttgctgatggactgtcttagaattgtataaattactaattgtattaattaatgcatttgaattttcggtaggtacatagcaagtgttaatgttgatgatcatgctttcgggacttacaaattgattcaaaattaaatctggcacaatcgggttacatctaattaatttttgccgagtataagtatcatctacacttgtccttacagtgatttcatttcctgttgcttcgatgataagtggtaattggatatttaatttatcggcttctacgttgatataagatttaatcatttctactaatccgtttaatgagtgagttttaatataatcaatatcgggtgtagtcactctattcaagcgagagccgaactttgtataaagcatctttttaatttcaatttgttctaatttattttcttcttttgcgtttactaattcttcaatcttttcaatagcttttctgatcattttgatttcctctttctataaataatttttatgatatctcctaaaccactcgttaagagtgtgagactctaaatatttggcttgtgcgacctgttttagtctaatcctagtttttatactcctgtgtgctgaatgaggcgctacacgatggcaattaacgcatagccacacctttagcccatcctgttcacatttttttctatcacccccgttcaaacagtgatgttcttctaaatttaaatttgtaccgcatagataacactctttattatcttgtattactgttttcaataatttctacctcaatccttggatactctttatcaactcttacatcgtgctccaatttatttatgtacttttggctatcatcgattaatatattttgcttaactaatgcatcttgaataaactttgtcgcaaatgttatattatctacatcacgacgcttatctttttcataccacgttatttttaatcggataggataattttttattttctttaacttatacaaattaattgcttgggctactgcagcttcgtttttagctttcattttgctacctttatagcgatttgaacggttagcttttgtatattcgtttagcccatctaatcgaccacatataacaaattcagccatatatgtcactctccaaaatcgggatatttaactcgttacaccaccttatagttgtatcaagtaatttgttcatttcttcagttgtgaatgtcgatgaaccatagtagcattgaaaatatgcataatctttgttggcatcatatttaatcaacttcacaactcgaaaacattttttaagatcgttctcagctatagccaacacttttaagatctcatattttgctttagtttcatttaataattttatgtaaacgtccatgtcatcttcatccatttttaaggctagttcatgtataagcgaccacaaatacgcattttgatttaaagacctcttagacctaggcttttttatttcgagcgaatacaactctttttccaattcttctgtattagctttagagttgtagtcacttactgcaaaagttatttctaaatctcccgtatcagggttgattacccgatgcagatatttacttaaaaccttaatcaaaactgaatatcctcctccatgatgtcgtaagtgttaaaatcattaaattcattttggttttgttttaaatcatcaaatcttggatctttaacatcatatttactccgcagctcttcttttggttttgtttctaaaaattgaacactatcacatacaacttctacaacatatactctttgtccttgagcattatcatagctccgcgtttggattcttccttcaacaccaactaaactacctttagaacaatatctttctacattctcagctggtttacgccaaacaacacaattgataaaatcagtttgttgctgaccgtctctagatgtaaagttacgatttactgctaaagtaaatgatgtaacagcatcaccttgaggtgttcttcttaactcgggatcacgtgttaagcgacctactaaaacaacattgtttatcatattagttacttccttttttatttaatttagctttatagaaaggacaccactgtttaacattacagtaatcatcacactttgtgtcctgtccttctctaaattcgatataatgcttgctatcaagatttttactagcgatatattcgttagcttcaatttgacttaaacatacctttaatgcgctttttctcccctctttcattactgcatatttatcatccttatgccatcgttcaacatctgtacacgggattaacttatcgtcacttaacgcttcctgtaatttaatttcattgaatttatttttaataaatctttcaatttctttaaaatcattatcgctaaattcaaacgaaactttatgtacaggaaattgaggataacttgtatcatatttagctttggatttagaatggtcttttaaagttgcaattatttcacctttgttacactcgaaaccaatcttttttaacatataagcatacattaataactgcttgcgataatcctcccaatcgttataaataactttccaaacagtagcggttttataatctgttactttcttttctttggcatcatataaatcaaaaataccacttagtttatatcctccatctacatctataacaattttgttttcttttaactgttctgcttcctcatcggcattttctaaaatagaatgaactgcagtcccaaaaatcagccaaatcatatccgacacatcccgttcaatctcattatggtagcgtctttccaagaccgcttcacacgacccctttaaaagttgagtcactgaatactgcttatccttgtattggtactcatgctctaccgcacttacaaaaggtgcgggtaaattgtttacattagttattttcatcttctctctccttatttgatttgaattttttaattatacatgcatatacaacatttagtttgtaaatatcttccaatggtgcttttataatatcttgtgttgctaaatcggcatgttttaaaatcagatcatttaactttcctctaaaatcaatccctaaactgtccatttcagacaccaagttagaatattctttcattatggcaccttcatccaattcttttttttgtggtttttcattcttagtatttgtttgtttatgcaattcatttgtatcagcatctttagtatcgtcgatattaaacagaccgtttaaagcatatttacgagcatacgatgatgcagcgcctgttatttgactatcatccataccctttttagaaataggttctctagcataagcgcaagtttctattttactatcgctatcccaatcaaagattatgcatattgcttttaggtaatttctatcggctacgcgctcaatttcatcatgtacaactaatgttgtacgatattttaaacaaattggcttaactgcttctagaatatcttcacaactgcggtatttgtaaccaccaaatttattaaactgccctttaggagcttttaactcattttgtatatgtgctaatttttcatatacacacatttttttctctactgtttccatttctaccccttcaattcttctacgatactttggtaatcatctattccatcttttaaaacattcaacagtcccataaaattacttgaatcattatttccatatccctcattaaaggcttcttgggctacttcttgcatacaagctgttatatcttcatatgcttccatgtattgttccaactctgcatacatagatttaaaattttccaaagtcgctattgctttttctaattctttagctttaactaaatcacttctactaaacgcctttcttagcgagtatgtatccgcattttgtagacgtatattatcgcttagttgttctaattccatctttactcaccgcctatatgtgattttgctagttcgattgctagtttgtattctttagcaaaattattgtttttgtgggtttgtcccactttatcagtaaattcttctatatttcctctaaaacatccgcatttaacgtaaatgtcattttctttagttttaaaaaaggttgtaaaatcttttcgagaacctataggacctacaagtaagtaatcagcattaccgtagacctcagcatcaccgtagacctcagcattaccgcagacctcagcattaccgcagacccaagcattaccgtagaccttagcattaccgtagaccttagcattaccgtagaccttagcattaccgtagacccaagcattaccgtcttggctaaggttgtcttggttttctacataaccacctaattctcctttttttacatttccaaaactttctaacgcttcaattctaaatagagttcttccaaaaacttctattttaatatctgttaatttgtatttcatttttattaattcctttcattttttaaattgatttataaaagatgcacgttagtgcttttatcttctatcttttatctaaaatcttgttaattgttatatcttatttgatatatggttagtcacttggttgctctgttggttatttagttggttaggttactgttttaaatcccctaaacactatatgtaccaatgactttataaacattattgttggttatttatatggttgctccgttggttgttctgttggttggaaaaaaagctatttttagcttatttcaaaatatattttcgattattccaactatggcaaaacccgataatataatcattactgttattgtaaacacccctcgagcgcttaatttatccatttgacactccttttttattaagttataatttgtttggttatttttatttggcgactttggcgagtcgtcttttttactgcttagcaaattctataatgtctttatttctaaatatttcacactcaagatacatcctgtaagcacgtctcatatgattgttaattgtatcgtttatttcttctcttgatgtacaagcaaaatagccgccagttcgtcccgatacacttccgataaaaatggtaaatttaggattgcatctaatattttgaataatcttacgcatagctttatcactctttacctgtttaaaaatgcctcttaattgacggtttttaaccatgttttctttaccgacgtaattggcaattatgtacctgtatacttgttcttctatttccatcatatcacctcttttaagctccaaatcttcttgttagccaattatccaacttagaagtatctattttccacggtgatgttgcaccagctttgtgtgcaggaaaaccgcgtattttagtatacttttttaactcccattcgctaaaaccgaacggcaatagctcctttattgtcatgtaacgtttaggatagctattatttgtggtagttgtttgcatattgtttaccctcctttgatatattgtttcatctcgtgctataattagcttgaaaggagatgatttaataatatgtataaatataaatataaatttgattgttcaaaacatgatattgtcattaatcttcctgagcacatgaaggacattaataataatcacataatgtttatgcatccatccgaatctttcggagatacaattgtcaacgtgaattatgaaaacggtatctcatatatgctcgttaaagctaataatgatgttttcgtttggtcgactgacaaaatcattccaagcggtcaaccaaatcattttgttttcgagattgagcctcaagcctaatccctttttgaccaatatggattccatgactatgaaattcatttttcttagattgtttctttcgcacagaagcaatctttttctttaaatatctaatcaatattttcaccccttttaagctcaaattgatagttaaacagtttgaatcaaattcctttactaagttgagtaaataagaatgatcacaacaattgttaaaaatatagtaattatatctattaccttatcttcaactttatttaatgcattcatgagagatataaatatcattattaaatcaattaataaaaacaaacaaattagaatatttttcattacttatccctttcttcatcgtcagcttatttagtatcttcttttgataaagaatagaattttttatagccttcataaaatgctaatgtaaatccaagaaataaccatataaacatcagaagaaaatacagaatagataaagcagtatgaaaataattatgtgtttgattaaggtattccatgcttttgataattccctttctaaatgaaattcagtatttgtcatacaattcatgaaaaataaaatagttccagcaattggatacaaagaatagaaaacaattccaaagaaatagctatttaccaagattcttatccatattggtttcatatgctactccttgtataaattatatctttcgcttaaagcggaacaatctgctaaaaaaataaaatctatgctagtatgatatagttttgctaacttatctaaattagccttatcaggaatagtaattccactttcccaattttgaatagttctttcagttttaccaattttttttgacacatcaccgatagttaacccactattaaccctccaagcttttaaagttaactgcatttttctcacctcctacgcttttattatactcgcttttagcgtgatgtcaacttaaaacggaaattttttcgcttttttattgtttctatccgctaaaagtgataatattttattaaggatagaggtgacgtttatggattcaaaacaacgacaaaaagatattttttcaaaaaatttaaaatatcatttaaatttacacaagaaaacacaagcagatattgttaatgatttaggtataacctcaagtactgtttcagattgggtcaacgcaaaaaaatatcctagaatggataaagtacaaatgattgctgattacttaggtatatacaaatctgatttaatagaggaaaaaaatgatttgacacaagaatttgataacatctttaaaattgaaaaaaagaaatttcctttattaggcgaaatagcttgtggcgagccaatttatgctgatgaggatagagaaagctatataatggctggtactgatatacaagctgatttttgtttaaaatgcaaaggtgacagtatgataaatgctcgtatcaatgatggtgatatagtttttattaggcaacaaaatatggtgaataatggagaaatagcagcagttattattgataatgaagcgacattaaaaagattttattattataaagaagctaatcttgttatattgaaagcagaaaatccaaaatttaaggatttagaatataaagatgaaagattaaatgaaataaggattattggtaaagcagttgcttttcaaagtgatgtgatataaatgcaagaaaaaagtaaattcaatatattcacctacattaaaaaacatcctataatttttgctattacattgattgttatatttattatggtacctatttctttttatgtggaaaatccatggggaatcggatttattccaagagatgaagctggtaatgttttaggttattatggagctatattaggtggaggattagccttatttggcgttgcgtggactatcgtagaacaaaaaagcgatttaaaagagcagcagaaacgtttagatgatcaaaggcgtgatgatttagcaatacaatataaaccactaatagaaatagaagataacggtttagaagaatataaatataatcaaattaaaataaaaatgaagctttctaatattggtagaggtgaagcattaaatctatttgtaaaaattttccaagaaaatggagataattattatatttctaataccgatattttttataatattttcccctcaaaaaaagataaagatattgattttgtatttacaaaaatcgatgcctcaaaagaatttaataaagagaaaggaaaaattttagctacgttacctcttgatgatattgaatacaattttaaaggtataattaactacgataatcctttttcaaataaacgatatattttaaacttttcgattttattagaaaaaattattcctaatgaacttttagcaaaaaaaaataactataactattcaaataaagaaataaacgaaagaagaatttggaaatcttttgttactatgggtggatatattgaaaccgaaattccaaaaaggtaaactataatattttatttattagacaataaagaaattgaaagagattatttatctaattgcagaagaattaaatagcacaatcacaataaacacacttcatagtgcaggaagggagaaacggggatggatgaatatattaaagagcgacttaatgatcaaatacagtggtatagtaaaaaatcaaagtattataaacgtttttattatggatttagcattgcattattagttatatcatctatttcatcaataatttcttatttaattttgaaatacaaacaattagaatttttacctatcttaagtacagttctaacagcaactatccctatcattattggcattgataaactaatgaagtgtcaagaactttatacaacttatagagcaacttgcgaacgattaaaacaagaaaaaatcctgttccaaaacggagcaggagaatatgaaaatttgtctattgaaaaaagaaatatcttgctagttaatagatgcgaaagtattatgtcacacgagaacagcaattggacacaattaaacgaaaagaaacaaaataattaatttaccttgaaatatgatttttcaaaaatatcaggtttacatgggtaatattcaccttttattccttttattataaaatcaccaatatcagctatatgatttccctcaagagtttgaataattaaatatgtttgctttggaacacatgattttccacaaaacgaaattatttcttgtgtattatcaccattccattgtatagcttcgattgtaacaggcttcttagtatacttattaatcatatcgatcaccctttcaaggttaattatatcaaatttattatagaaaggaagttaaaacttatgccattattaaaaacatatgatttatttattagtcatgcatggatgtatggcgatgattatactcgattagtcaatatgcttaacaatgcatcatatttttattttagaaattactctgccccagaggataaaccattagcattatcaagaacatatgcatacgattacgaaattaaacaagcaattgatagaaaaattgccccagtaaattgtgttattattttaggcgggatgtatgctaaaagaaaatggatgcagtatgaacttgaaacagcaaaaagaatgaacaaacctattgttgttgtagcaccatggggacaagaaaaaatacctatagaattgcaaaaatatccattagtacgttggaatacagaacatattgtagaagcaattagaaattattcaatataacaaaagttcgactgctgacaatagcaaagaattttatttttaaaaatttgattagcttttactttcaataaaaaagccctccgttggcgcggagagcagacatgaaacgcaaacaactaccacattatttagcaatccatgtagccatattttaacatggattgtctaaaaaagaaaggactgaattaaatatggctaaatataaacaacgaaaagatggaagatatgccacttctataactctaggtggtaaaagatatcaggtttgtgaaaaaactataaaagaagtagatgaaaagctttttcaaataaagtataaatacgagcaaggaatattagtaagaagcaaagaagcaatatttaaagattataaatgggaatggtttaaaacgaaagagccactaattagcgctaaatcagcgcaaagttataaatctctattgaataatcattttattgaaattgattataaaaaaatagcagatataaagaagactgatatccagaaattaataaattcattaatcgataaacctaataccgcaaataaagtttatatgacattaaaccaaataatggaaagtgcgattgatgatgacattataaataaaaatccatgtagacggatagtaaagccaaaaatggaaactaaaaagcaaaaaagaatcttgacggatgaagaattctatttaactgaaatagccgattttaatgatcgagaaaaaatgtttgttttaatgagtaaatattgtggtcttagacctgaagaaactcgagcgctaacaaaatcagattttgtaataagtaataacactggatatgtaattataaacaaaacagtcgtatatacttctaatcaaccaatttttcaacaattcacaaagaataatagcagtgttcgagaagtacctctattcgccaatattttgccatttgttagctattatctatctagcatacaaacatctaaactctttactaatctaactggtggcgacgaatatttaacgaatcaaagttataaatggcttgttaaaaaaatcatagacaaaataaaatcaaaagctttagaattagatatagaatttaatccaaaaggatttacaccatatattttcaggcatacatatgcgactttattatattatagtggtgttagattaaaagatgctgaatattacatgggtcacagtgatagtaaaatgcttaatcaagtttatatacacttagataaacataaattaagagaaaatgatactgtcgaaaattttgttcaaaacaaattaaaaaacaatcgtaaaaacatactagaaaaactacttaaaaatgagtagtttttttgcatactttttgcatacttttaattcatttaaatatatctaaatttacttaaatacaactaaataaattaaaatcaaaagaaaaaataaaaaggcttaaaccttagtaaaacctagtgtttaagccattatttacaatggtctcccctcacggtctcgaaccgtggaccctctgattaagagtcagatgctctaccaactgagctaaggagagatgacatttattataatacacctatttttagataaaagcaagtgaattttaatgataaagtataaaagttatgctataattaacaaataggtggggtgagtatcaaaatgttttataaacagactgtaaatgatataaaagtagttattttgtcattagatggcggattattggatttaaatcgcttaagattcaattattttaaaagaatatgtaagattcataatcaggttttaacaaaagaagagtttgaaagatcattaggcaatatgcatacaatgtataataattttcctatcagccaagatattgtttctgatgatttaaatgaattgattgaacgtgatttatacgaatatgcaaaattaaagccaaattcgttaatgaaggaaggtacagaagaattattacaattttttaaacaaaaaaatataaaaatcgctgtaatttcgactcataaaataaaacgtgccatccaatatttacagttaactagactatacaattatgttgattttatcattggtggcgatagtaacaatcctccgctacctgatccttatctattatctataattttagaacaattaaatgttacccctaaacatgctttagtagttgcaaattaccctagcttattgtatgctgctaatcaaaaattatttaatgttatttatttaactgatttatgtccagcagttaattcaatttcttatcgagctttaaaagttgctaaaaacaatcttgaggttatcaatattttcctttttgcacgatatgattctatggaaatgtactcgccattattaggaatgtctagcgatatgtccattgaaacacttgaacaaacatattataagctgcttgaagaatacagtaatgattctcaattagtcgatttagtacgtcaaacatatcattactttttaggtgaaattttagataaaaaacctaattctgctaattcttcattatttgaagatgaaaaagcatctaatcatcaagaacacatagatactgaggaaaatacaactgccaaaattgacaattcttcagaagatttagttaagcattttgagttttcagatgaacctgagaatgtaaaaccagtaaatgataaacctataattggtggtgatcctaaacgagttaatgaacttatggatatcattaatggaactattaaagaagaaacttatcatgatgagatttctgattcttctccaattgaaaaggaagaaacaaatataattactcatgttattaattttttctatactttaataatcgtaacaattatttctttttctggaatgcttgttttttcagcttttaaagattttatctatgaacctggtgtcattacaggaataataaaaaagctaatagatttatatgttaatatcgttttaagtatctatgcttttatttttaatgtacttcataaaattttaaattttattcctgattatgataacttgatttctggtaataattttttatcaagtcttgcaattaaattaatattatttattatttttaatttaattattgtatatattataaaatttataactaaattattaaaagagtcggaggaagataatgacccttatccaaaaaattaaagaaactgatatcaaagtatcgtacatttttccaaaattatatcatcataaattcctatgcaaagctatgacccttattacaggtgtcggtgattttggtatgatctggttatttttgatattcattttaagtctaaataataaaactcagcttttagctcaaaaaatgcttgctgctttacttttatcaaccattattagtcaggttattatcaaatcaattgtaaaaagaaaaagaccctgtcaaacttacagcaacattaaaatgctgattgctattcctagtgattattcttttccatctgggcatactgcatcaagttttgcttgtgctactgctatatgtttcttttttcctaaaaccggcatcttatttattctatttgcctttttaatatcattttcacggttatttctatttgtccattatttaagtgatgtaatctttggaataattttaggcattcttgtgggcattttggtaatgatattttaaaaaaacagcatgtcttttaagacatgctgttatagcattacataaatcaaaataacagcaattagattctttatgctatgcaatacgattggagcaataatattttgccttctttcataagcataagaaaaggctaaaccagctgtcatatagggaatcaatttcaaccattctgtcatatcaccagctaaaatataactataaacatgtaataacccaaataaaaacgctgaaatcaagtgtgcccaaaaggcacttttttgacgtaaagtattaaaaataagacctctaaaaaataactcttcaacaagtggtgctaaaataactgcatgaactgtcatcaacaaaacatttgaagatagcatagtaacaacaaatgtctgatttgtcgcttcacgagtatcagctgataaaaataaattaactataaattcacctatatacccaagtacatatgatgatattatcccaatcgttaaaatccaaataatattttctaatagctcttgtcgaaatatttcccaattcttttttataaaatccttaaatacagctaataacaatattgctgtagataaaccaatcaaaacattaaaataaacattgattgattctgaagaaacatcattacttataaataccgtatataatttaatcaaaaaattaaaaatacttggtgcaaaatataaataccagggaaacaaaataattgtcccaattgctttttgacgattacttaattttatttcttttatcaaactcaatctaacaccccattaaataagatttttatcctctaaatcaatttcttcaaacaacactgcaagacaagtctgcatttcagctgaaaacaaataaaccattatcactgctatcaataaatcggaaattagtggaattggtaaaaatatttgaattaccgctgttatcacgatcgttaataaaaaccagcctaaatatgaaagatataaaacaaataaagttcctttatgtcctttcatcaaacgtgctgattcactcatcgccttagccccataaatcttatatttctctaaaacatatggtgttaaagcaaaagtcaaactatacattacagcaataatcaaaataacaacaaatcctaatgttataaatccccctaaggctcctgccattttgataaaagcaggatcttcaacaatcgtagtaagattacttgtataaaggcttgattgtgttaataataatccaaaattatcaaacacactttcatcaataactattttagcgataaaaaataatatcaaactagcaagcaatacaagtactattaaaaaaacaatttgaataaaataagtaaaaaacaattctttaaatcttttaaatcctgttaaaccttcattttcaattgtaacttcatctccgcgttcatttactgcttttaaagctgtaacaatatttccatgagaaaatggcagcattattattgatattaataaagagataaatggtattgtcacattcaatgtttgaccaagataatctataatcgttgttattatactaataaagataaaaacaaaaattatattactatgatctttcaaaacgcttttagcttttattttaatatcccgaatattcatttagaatctacctccatgagcgtattataacaaaaaagcagtctaaatgtaaaattatttaatatctaagctagttttgattgcctgattgatcaattgcattattttatcatctatgattccaactttctctcttattctttgtttatcgatcgttctaatttgttccaataaaataacactttttttctctaaataattattttctaccataacatgtgttggcaatggattctttgttaatttagatgatatcggtgctacaataatcgttgtagaataacgattacctttattattttgtaatacaacaactggacgataaccaccttgttcacttccaatcactggtgataaatcagcataatagatttcccctctatgtatcatatttcacaactcctttagtgcaatatatgaactaaacaattttttattacttaaattatttaactgtctgatcattttatgttaggataaaattaacggaggtaatgataatgatcaaagctgtgatttttgatatggatggtttaatgattgatagtgagcgagttacttttgaaggatatcagcatgttttagctaaaaaaggattaacgatgtccctagatttttataaaactttattaggtaaaccattaatagctgtttttaatcagttttatgatacatatagtaaagattttaatgtcgaagatactattgaggcagttcaccaatatatatcagatatatttgaaaatgatggtgtcccattaaaaaaagggcttattgaattattgaaatatttaaaagctcataactacaagacgattgtagcaactagttcccagcgttatcgagtaaatcgaattcttcaattagcaaaattaaatcaatattttgatgattctatttgtggtgatgaagtaactaaaggtaaacctgatcctgaagtatttttaaagtcatgtgaaaaattaaatgtaaaaccacacgaagcattggtactcgaagattctgaagctggcatcaaagctgctgatcttgcaaaaattaaagtgatttgtatccctgatctaaaatatccagatcctgaatttataaaaatgacatataaaatcatgaatgatttattagaagtccgtgatttttttaaccaagattaacttggtttttttattagaataatataaaaaagttggttaaaaccaacttataataaatttaaatcaatcatttagcaagtttatctaaagcatccttagccgccttttgttctgctctttttttactagatcctactccaacacctaaaaccatatcatccatttttacagccatctcaaaaacaggattatttgaaggtcctgtagctgaaatcaaatcataagtaactgtttttcgctgatcggcttgaataagctcttgaagccttgtcttaaaatctgttatttcatcataattaacatctttaacatgcttataaacggttttgtttaatactttttcaacatattcatgaccgcaatcataacaaacagcgccgataaaagcttcaaaaatatctgccagaacactatcacgatcacgtccaccattatttaattcgccagcacctaaaaaaatcaatgatcctaagtctaattctctagcaaaacgagccagagattcttcgcgaactaatttagcccttaattttgttagacgaccttcgggtaaatcgggatataaatcgtaaatatgtcgtgaaacatgatactgtaataccgcatcacctaaaaattctaatcgttcataatcatgattttttaacctatgttcatttgcataagaagggtgtgtaaaagcttcgataaaaatatctatttcgtgataaggtatctccataatttgtaaaaattgttttaattccacgttatttcaatccttctttcattttttctactacattacttgaaaccatttcaaaagctaaatttatagcattttcaaaagcaacagcatcactagaaccatgagctttaattaccggtttaacaaaacccatcatcaaagctccaccagctgctttaggatcaaattttgtcattaattgttttaaagccggtttagccattactgcacctaatttagtacgagtcgaagacataaagccatcttttaaacttttcactaacactttagctactccttcagttgtcttcaaagcaacattaccagtaaaaccgtcagtaactatgacatccacctcgccatctaagatttccttaccttcaatattgccaataaaattaatttcttgcatactttctaaaattttatatgtttcctgatggatttcatcacctttatgatgttcacttccgatatttaataaagctattttaggattatcgatttttcgcacatttttagcataaacattgcccataattgcaaatgattttaattgttcgactgtattttcagaattagcaccaacatcaagcatagctacatctttaccattataagtcggtaacatcgccattaaacaagatttttctactccttctaaacgttttaaaaatagcattgcactagcataataagctcccgtatttccacatgacagtattgcatcaacttcattttttcgcgccagcatcattgttttaaccatgctggattctttttttctgcgaattgcaagaatattttctgtcatttccaatacttcttgagcatcaattaaagttacctgagaatagggttttaaagcttctaattcttctattttccctaccacatataactcatcagttttatttttactaagaaatgataaacatgcttcgacaacgatcgaacttcccaaatcaccactcatagcatctattcctaatttcatttttttcacctcatattagtacatattataacacaaattaatcaatatatttattattgttgatcaattgttcttcaatctcattaattaattttaaatatgctgcatcattagatttactttctaataattcctgggcatcttttctagttacttctaatatattaatatctttaaaaatatctccgattgcaaaagctggtagaccactttgttgattccctaatatttcaccaggtccccttattttcaaatcataataagaaacctcaaaaccatcgtgacaattttttaaaaactctaatctttcaattgcttctttactagaagaattgctcagcaaataacaatagccttgttcatgaccacgaccgactcggcctcttaattgatgtaattgacttaatccaaaacgttcagcattataaattacgatccaattggcattactaacatcaactccaacttcaataactgtcgttgaaactaaaatttgaattcgattatctttaaaatcatccattgtcttttctttagtttcatcatccattttaccatgaagcagtcctactgtataatgatttttaaaataagctttcattccctcataaatactagttgcatcacggctatcaataacatcactttcatcaactaagggacatacaacataacattgcccgccactagctaaataattttttagtttatttaaaataggcttcatactatgcgattttatcacttcagttaagaccggttttcttcctctaggcattgttttaatagttgaaacatccatatccccatataaactgattgctaaagttcgcggaatcggtgttgccgacataaccataaaatctactttttgacctttttctttcaatgctttacgctggtttacgccaaagcgatgctgttcatctgttattaccaaaccaagattatgataatttactttttcttgaaatagcgcatgtgttcctacaataatatctatttttccatctctcaaatcttgatagatcgcttgtttttctttggttgacaaatgtcctgtcaataaacctatattaacactagtttctttaaataattttattaatgattgataatgctgtgttaccaaaatttccgtaggtgccatcatagcaccttgaaatcctgctaaataattggcatacaatccaattgcaccaactactgttttaccacttcctacatcaccctgaataaaacgatacatcgtcgtatctttttttaaatcattaattacttcatcaactgctttcatttggtcatctgttaatttaaagggaagctttttgataaactgctctaatattttttgatcaaaatttttcttgacaccaatattttttttacgtgagatcttaatgtattgcattgttaattgaaattttaaaaattcttcgtattttaaatgccgtgaagcctctttaatatcattattgttagctggaaaatgaattagatttaaagctaattctttatgaattaaatgatgtttgatcaataaagaattaggtatttcatcttgaatatgtccctgataaaattttaaagcttttttcacataattctgaaatgacttttgtgttattccttcttttaatgaataaactggggtaatccctgcaatttcatttaaagcctttaatttaatgtcactagcaacaatgctattattggcactattatacttaccaattactgtcaaaatcatccctttagtcatattttttttcataaaatgacgattaaaaatcgtaattttataaatttcctgctgataaagaagtgaaaatgtcaacctggataatcttcctttaaaaaagacttttggttcctcaattaaaacaccttcaataataactttttcattatttattaaaggtgtttcctcaatacactcataacgatagggaaaatgaagtaccagatctctaagactatttatacccatctcattcaataatttaattctattttcagttatctttatctgctgtaaaggaatttgtcttgccataatatcaccatgactattgtatattatttatctaaaaatatctactccaaacattttattataacaaaacaacagctatttttagctataatatcagcttttagcatacttaatcatttatttttttattaagacttttttaactctaataaaaaataagttatcatttaaaataacttatttttcaatcaattcaatagcctgcttcaataccgctttaccattcatttccaaaagatctttttcttcaattacggcaatcggaatagaagttttaacaatagaacgaactttttcaagatctccagcattttgtggtgctattaaaatacagtcagcctctgcccaagataactcgattgcacttgaaattgctgtccaaatcattacatctatattttgtctatgagcttcttttttcatcgcattaacaagcatagttgtagtcaatcctgacatgcagcaaagtaaaattttatacacaattatacctccatacatattcttttatattatgcaacgattttatcacaacgagacaaaaaatactacttttttatcacaaaaaaagataattatcatttaataaaaataaatatattattcacattcttttcacaaccctgatctctcgattattctacattttaactatttaataactttgttagatctgcaatcgaaacatccattttcgaagaaacttcagccatagtcataccagtggcaagaaaacgttttacaaccattttcatctcttccccgacttcaataatatgaccatctaaatcataaaaacgaattacccgctgtccccagctatgttcaacgatttcaccacaatattcaatatcaggatattttttcaatttatctaaaaaaagatcaaagtcctgtttttcaaagcatatttccatattatttgatttttttaatacctgctcttgggggatattaacaagccaatcaaaattttgttgtaatgctaacccacaagtaaaagcaatatttatcccataatcttggaatacctccaaaccaaataaatcttcataaaattttcttgcagcattgatatctgacactgaaataaccgtacaattatatttcatataaatttcccttctaattttaatctattatcattttcttcaattgcctttttaaactcctctgtaacatatatctttcgattaacaaattctggtaatttaaaaataattttatctcttaactttgattttacaaatacatattgtataacatccatcactctgttaaatgatggataacgcttgattttagaacgatcataatcaagacaatcaacaacttcaatcacattgattacataaaatatatcatcttggtttttcattcgtaatgcttggatacgccctttcatatatcaaaagcacctttatttaagataaaagaacttacatccacactaaatacatcaccaatttgtttattgacttcatctttatattcgcttggcacgataaaacttaattttctatctttcactatcttgccttcaaaaatataagatttataaccatttctaggcaatgtctcataagttctataagtatgtaattggtatacttttatatttttttcaatgaacgattgtacaatccatttttcttttagtttgtagtgccagttttggcagtgaactaattacccgtgaagtaacaactttcataatctcatctcactttcaaactacctgttaatttatttttccataagataatttattaaagaaatcccatttctaattactttttgttctttaattatcttatatcctctcctttcaaaaaaatgctttgctgtaatagaaacatgaacaactttttttccattaactacttgttctaatttatcacaaatagctgtcgcaacacctcttccttgataatctttatgaacatataaatgatcaagatatccatttttatcgatatctccaaaaccgataataattttctcatcgactgctacgaccgtataatgctttaaaaatgattgattccatttttctaaatctatatttctagttgcccagacatttaattgttcttggttataatctcttgcgttaattgtatgaacggtatcataaaataatcttgctaactcctggctatcagatggctgatattttctaataatcatttttctctcctaaaatctaatttgttaattttattataacatcaataaatacccatgtcattttccaatcccaataccaatatcataaatagataatctaaatttaataactttttgtaaccatcgtaattttaactagtaagtcaaaaaagaggcctgtatttaatagacccctaattgcaatctatttctttacagcctcttatatattaatttaatttttcttttttagtttgaaataaaattacgccaccagctacagctattagcaccattggtaataggacatttaaattatctccagtagctggagttttattttcattaccagctatttcttctaacgctgctaatgcttcatttaagctgttaactgcttgatcaacttgttcttgatcagcattttcatcactataaacttttcgaccattttcaagtgctgcaactaaattttgataagattctttagtatatttagtttcatcaattgcttcagcctttttgattgcttcaaacaatgcatctttatttactttaacttcaacacttggtttatcagaatcatctggaatttcaaaaccagtttgtgaagttgtattagttgaagttaatgtattttgatataatagatagaatgctgaggcagaccagctgaaattctttgtatgtaatccttctcctgtttctggattataattttcatgaataggtccatcttctaataatcctttagcatgatcaaataatttgatcgttacttcttttgcttcttcattatatccataattttgtaaagcttcgactgcatataaagcttgatctagccatactggtccacgccaatatctacttggatcatatttatcgttatcttttgaagctgttgggaatggtacataagtattaaatttattttcatcaaccatattttcaactactctagctgcttgtttagtagtagctgctttagcccataatggaatccatccttcagtacctttaccacgattaactaataattttttaacactaccatcttcatttgtttgcacgtcataatagaatccagtttcttcatcatacatattttcattaatgtagtctcttaaatactcagcttctttagtgtattttaaaacatcatcagtataccctaattcttcagccattgattttaagaaacctttttctgcatataaatatgcatttaaatctactgattcttgattgattacataaccaattggttcatgatcatcatttctaacagtataaattttgattccgatatcatcatcgccattaccttcaatatcaaaacgtgttgcattatccataccactttcccatgcagctgcttcaattccggcttcaggacaaacgattctttcattattagcatcataaataaatccgttattatcaacagttccaaatccttctacaacttcaccttcagcatatccatagtttctccagtcatagcaagtttcatgaaccattccaccatattcagcaataccatttttatcgatatcacgatttgtataccaccaattatgatatgcaactaattttggatacatttcttttaagaaatctttatccccagtttggcgataaacattttctaccgcccatgcagctaaagctggtttagaattacgttcgttccagttaccaccatcaccaccgcgatcttcattttgattatagaaaatacaatcaataatagctccagcatcttgagggcgtacttcatcatcacttgttatttgataatcaaacaatgctcgaacattatttttagctaattcttcattgaaatatgttgttgcaacaacttgtttccaagagtcccaagcccacataccaataaaccatttatatgacattgatggtacaattccatcatgttttattgctccagctggtgaaaaccagttagtcatcaatgtttccattgattttacggcagcattttgataattaacatttgcagttatatcatttttaaagatcgtatcaacatatccttgccaacgatcattgttttcttcaaaatatttagctggatctgctaataaatcagctacattttgtttttcattatttctttcatcaatagtatatgtaaaactttgtgtttgataagtttcatattccccttttgcttcaatagtaactggttcatttctagtaattgtataagataaattatcatcactaatttctgtagtaatgtcatcttcactcaatacaacatcaaatgaattttcttccgttgtcatataattccatgtactacgaatagtcttaaagtttactttaataccgtcgttttctttagataatgatgtacccattgaattatttttatttgtataatatgtaaataaatgtccatcccatgataaattcaattttaattcatcattagtcttattttcaattactgtttcaatcaatgctgtacgattagtcccaaaaattaattttaactttaatgttaaatcatttaaatcatatgtttgttccaatctaccaggataataaatttcatttgtatttgctttagttaaatcaactatttctgatccttcatctgttactttttctaaatttattttattgatcgaatcagataaattaattggatattcttcagcaataattactggtcctgcaaaaccaccatatagatctgtagcatttttatcatgaagataatatccatgccaagctcctaaatctgaaaagttattatactcatttgtgctatatgtcccataaatagtttcttttggatctgctgttacatctagaacatttgcaaaatcagtcaatggttttgaattatctgctgcattagcaatcacaactgtagaacccatcagcgtaagtgttaatccagcaattaatcctttccttaaaaatccccgttttttcattttatttctccttcttgataaattgtaaaatgttgttaacgggctttaatgaatgcgcgctctccactaaaaaagcattaaccacacaaaaaataatataaagataaaaaatccttatatgactttagtatagttaatgcctgccccaccagttacacactataaacaacttttacacataatacattatcattgaaaacgcttactgtcaatatagataattaaaattgtattatttttgatacatttttgataaatttacttaaaaacccgattaacttttaaagttgatcgggtaatataagctaattagtttttaaaaatttcttttttaaaagaattgatgaaacacataaagcaataacataactgcataatcctaaatcatcacctgttttaacagcagcattttgattatcaagtaaatctcctaatctattattactagcaccagatacagtagtacctggttcattattgtctagctcaggtgctggcttcaaatcaggcttgattgaatcaggatctgttgttaaagttatctttgcagttccagaaggaattccactacctcccgttaactttacatttttagtagtgactattattttctcaccaacagcatcgccaccttttttacgatcatttggtgataaagctaaactatcaccaccgttactttcaagattagctactgttatcttaccataaccagtaattccatcaccgccatcaccataatgaccataaccaccattagcaattaatgtccctaaaccagaaataattccgccgtttaatacaacaccattaccaccttgaactgatggataaaaaatatcttctcctccaccagtagcagttaaaatagcattttcttcaataataagttctccattaactaagatagcattttgacctggtaatgtaccactgccatcatcgccttgaatagtattagtacctgacacagttactcttccatttacaattacaacattcaaattatctggcttattagcaccatctgttaaatagcgactatttgaaataatttgagcatcttttaaaacactaccttcattcaaggttaaagtatctgtcaatgctgaagagtgtgacattgtaaacgttccaccattaacctcaactggtccaaaagcaacagagtcttttaaatgtaaactaccgcctttttcaacaataatttttacacttgaatatattttcatgttttcaatagttacagaacatcctgcaggtatcgttaaagtttctaaagcatatccttgattattaccaatgattccatataaaccagattcatgtgaaccataaatattagttaaattaactggtacgatactatcagcacatttagaaatttcatatggttccatatcccatgaagtaattgttggatctaatgcatcaaaacgttgttgtaaagtttgatcatctacataaatacgtaattgacattgattagatactacagtttgtccacgatcagttaatgtagcttgaacagtatataccccagctttttctggcgttccagaaacggcgattgtaccattaatattaataacattcattccgcttccttctggagaaatagaaacagataattttgctcctgaatgtttattttgatagttatagtaatccaatttatcagttccttctattacataaggagttagataacattggtatcctgtttgtccaacagttacagcatctaaagaaccttctaatgttaatgataacttgtcattaatttttaaaggtactgttttttcaatagatacatctctttcatcatcagatattgttttaatattaacagtataatccccagtatttactggtgtcccagtaatttcaattttattatcaacaacacttgcctctaatccgttagtattaggtaaaatactaatttctaatgaagcttgatcactgtttgttcccgttaattcatatgataaagaatcataatatgcttgccctttgacaccatcttttaaagatgttgacaacattgttagatttaaaggaataaaagatggtttggcgtttccaatattttctggttcaatagttgttccagcatatattgctgagccgttattttcgatttttccggtatcaaatgtacaattagtaaaagttgctgttccattgttagtaactgtttgactaaaaatacatgattcgaacactacatttgctccttcttcaatcaaaagcccactatcaatatcaaatgtaatatttcttacaagaacattactattagcaccaaatttcattgttccaccacgaacatctttaattgttctttgcattgctttatcttcaaaaaagttttttgcccagcctaataattgttcaacattagagccaatcgtcgttgttccaacacctgttaaattagcattaactttaataattgatgcattattggaccagcctaaataagtatctaaattatagctgttatcatcaataatatattcatcattagctgcatatacttttgtcatacttgcagctggttgtaacatcacaaccatagctaaaaataaagaaagtataatttttttcatatccaatcctcactatttattttgtggttagcttaagctaacaataagtatattactacctccccatattgtcaataaaaacatgatattttgttataaaaaactaacaaaataaactacctaaatctaggtagtttatccgtgtatactatttttcttcatctcgttttgattttcttactttccatgtaagtccacttgctccaaatgaagaaattgctagactcatccatccccaaatactagctggatcacccgtttttggatcatttgaatctgttttgtcacctgaattatctggagaagctgttgatgaattattaccatttgtaatatcaccagatggtaaatcattagcattatcagcttttactaaagcatcaattgcactttgtaatgcttttgcaatactatcaactgattcttgagattcttttgtttctaaaattgttttagcttcatcaagaactatttgaagtgttgaccagctgtctgcagtataatctgtttcttttaatgcctctgccttttcaataacagattgtagtgctgctgtatcaatttcatcaactggctcatcttttggtgaaactacagttccagatactgatggatatccaattgattgaacatctaatacatattctgcaccagcatctgggaagactactgtcgtatttcctcttgaagttatctttgcatcaaaatttactgttccatcttcattgaatactgctgtccctagattgtttccttttaatgctgttccatttacactgattcctgatatactgcttaaatatgtcgctacatctaatccttctggtaatactaatttgttgtctactagttttacatctccttcgttatatccagctgtcaagatgacatttgctgtcatatcttcgtatgactcatctgtatatgtcaatgtatattgtccgattcctgtattagctgtcttatatactgttaagacattgttttcatatttataatctgttccggcaactaagctgtttcctttatagcttacttctgtcaatttataactgcttccttctggtgcctttatactcattgccacatttacaccatcttcatataccgcatcttttccagttgcctgatattcttcatctaataatttcttacataataagtttgtattgattactagatctggagcatctttgatcagatatgtgatctttgtgattgtttttccttgtaattcttcatgtcttagataatcgatcgcattaccttgaggaactttgaatccgtcttttactgcaaaagcgatttctccacttctcaaccatagattttctaagtgttccattccatatttcttgccatctgatgtctcaactactacaccttgcatattatcacttgttggtaaatattctgattcgatatcgatttgataatgtccccaagttgtatttgtagcaatttctgctgttgcttcattatctacgacagtctcactaaccattgctcctaatgttccatcaccgttcaatactttatattctgttgggatcgtatcagtcactgtcatattttcaatgattgtcaacaacttattgttgcatcctttaccttctttgattgcttctttagcagcattgtataaagattctggtacagcgatattaacatcttttaatccttcgatttctacacctgaatcactttgtgtataataagtagctcctaatttagttgatttagttgttgttgcactacttacagcatcatacataccatctttacgataattagatgctgttactttatctgctgctgttagatccatcgttgatgaagcttcaacgtcgtttaattcaccgtaatagaaatctgcatatgatagatctactgttccataaatataaggatatttttttacaagtgcatctatagctgctgccaattcatcagttgcttttgtaatttgttcttgtgattcttttgcttctaacgcttgtttagctaaagttaatttttcttgtaatgttgcccatgattcagcagtataattagtttctactaaagcttctgcttttgaaatttcatttgaaagttcctcagtatcaactgttgatgctttttcggcattttctaaagcttttaaagcagcagctttaatggcagtagatgtccgtgttgcgccacttacagtgtcccattgttcaatggtagctgtagttgcatcttttccttcaatcagtgttttaaatcctttgcttttgctgtaagctttatcaaagtaagattttgattcactgtcaaaatcatttccagtagtaacattgacattagcaaacttaccgttttctacttgtaagtttactgtaatatcatattctccccattcttcctcgttttcatcgtcttcttgagtccgcaaaactctttgggtactttgatatgtgccatcttttacaatatcattagcacctattccaaagactgatgttggggtaagtcccaatgacattgtaaatgccatcatgacagcaaacggcttgtttaaattcttcttgtcttccatttttctctcctctttcttaaaatattaattaaatagttagaaacttctaactatttaattaatattttttgacttcctttactaactgtaggaagaatccttttagcaagaaagccaattaaaactccggttattattcccgcaatcattaatggtggtaaataataaataatcttattattttgaatgatcaagatagcagccaaaatttgtccaatattatgacttacaccacctgcaatacttatccccacgattgaaaaccccttaatattcttcaaaagcagcataataagataacttaagattccaccagataaactatacattaatgaaagcccattaccaaataaacatcccatcaaaagtattctaactaacgaaataaagaatacttcctgcggttttaaaatataaaaaccaatcaacaccactaaattagccaatcctagtttcattcctggtaatcctacgtttataggaatcaacacctcgatataactaaaagtcattgctagagcaactaaaattgctgcataagtcacttttctgctcatttttaccctcctatttagaaatcccatctatttcactaccagtttcatcttctaaaataacttcgacaactaatttatgtggtaaacaaacgattgtctcattttctctactgatttcattttgatccatgcaataaccatcaggacaatcagcttcaatcatctttgctttaccatcttttatctgggcagtatttattcctagatcttctttaatttcgattgtttgatcgtcctctagagaatatgtaccataaacttcaccatcaattgtaatcctgatacgattacctgctgtttgatgagacatatttataaaaacaaacattaaaaccgctataataagcaaaactaaaactagatatatatctctttttttcattcattaaactcctgcccaaaaaagcaatgacattaataacaatgctttaaaaatcgtaaaaaatacttcgtttcctttaagctccttgattccacaatgaacattacctttaggacaaatatcaatacatttttgacattgaaaacattctcctgatgtttctaaagaacctgtacttggtaattcaatatttgaaggacattttcttgtacagcctgaacatctattgatacaactttccctatcacgtcgcaatgagaaaaatggcaatactggtaataaggcaaatacagcacccatagggcataaaaacttacagaaaaatctttcatgaagcagcattccaattataatcaataataagattatgacccccggaatatatgcccctaattttaaattaccagcatgaatcattgaaaaaacatcccaagggctgtaaccatttgtaacacgataaacccctgcaaaacaagctacaactattgcggctaagataatatatttgatccaaattaattttttagctaaagcatcacttatcgaaattggtttcttttttaattttttacaccctttgatataaagggcatggaatgcatcgcctagagttccaaaagcacaggcaaaaccacagaaaaagcgtccaaaaacaatcgtgtataaacaaacaacaattaaaatcgtagtaaatgaagttaaaccaattttatccccagtaccaatttgtgtaaaaacatattttacacctgcaaaagcagctgtgtatacagaaggaataaaaatgaagtataatagttgaataaccgctcttaaataagtatgaatcttatttaaatcttttttagacatgttatttaaatctaactttttcatcctaatttaccgccttttctaaagctttagctacagcatccttgattcctgtagaactaaatgtcgctccacttatagtatcaacatcactagactgtttatcgataatatcatcaataatatctttagccatcgttaaataagcactgtcttcaccatcagctgatttaatattaatattagttatctttttatctttgaccactacttcaacttcaatcattccaccaaatccctgagcttcaccactataagttccatctttataatctgatgtttgactacttccatcactagttgtaccaactgtcaattgaagactttgcaactgggcattcagcttagcaatttcatcatctttattcctaaattccagcaaaacattatagccaataactatacctacgatcaaaaataaatttatcacttttatcacaaaacttttcattttatcagatacactctttcttactaattttcaatttctgctttacgtttagcattttctaaagcctgagtacatgcttcaataatcgattttgaagaacaagttgctcgagatacaatatcaatattatcagtaccatttttctcaataatttgtgcaacgactcctggaagtctgctggttccattaacagctctattgatataactatcattatcatcaagatatccatcaccataaccttgaatatctgttacagctgcaattttaccatctttgataattatttttaaagaaatagtatatgcttcaaaatcctcatcttcatcaggattacataaagcttgggctgtatattcaccatcattgtataatacatcttcatttgggttgtcaggaatgatcggttcttctggttcacttggtgtatctggtttgccataagttgcttctttagcctcatcaagagcattattgattgcctctaaaattccattagaactaaatgttgctccagatactacatcaacatctgtattttgttgtttgattacattagtaatcactgctttagcgcgttctacaaacgattcatcatcagcctcaacatcagtaattaaaattgctttaattgtgtgatcttgaagaactaaagctactgaaatatctcccatataaccttcaccacttccataatatactccgtcattatatggaatcgttcctgctggtgcgctaacattactattattattttgattagtgtcaacagtcgttgttccttgaacagcagcctggctcaacgcatttcttattgcttcaatgatcccaactgaactatatgtagctccagatactgtatcaacattcgtactttgggttgcaataacatttgttataatagcctgggctttttgaatataactagctccatcactatgatcagtaatcttaatatcggctatctttccacctgaaatatctacttgaactgtaatttttccaccaaaaccagtacccgttccataatatgttccatcacgatatgctttaggatcatctactttatctaaaactgtacttttagatgaactgtttgttttagcaactgtattatcatcactttcgcctgtaagagcattttttacagcactgataattccattagaactataagtagctccagacactacatcaacatctaagctttgtgatgcaataattttatcaattacgcccttagcacgattgaaaaaagccgcatcatcagcttcaacttctaaaacattgatagctgtgatcgtcttatcttttatttcaactgaaactgttatttttcctgcaaaaccagtcccaacaccgcgataaactccatcagccaaatcaaaatttccaacagcaatcacattattttcctcttgcttattatcatctgcggccttaatttcaccggcttttatttcatatgttggagcaacataatttacaactgtaatcgccatacaaccacccaaaataattgtcgcaatcaaaggtgcaaaagcagttacctttttataatcactcatcatttagccctctctctttacaatctgtacttccttatcactagaaaaatgctctgcaatgccttcactaacatatatcgtactattatcatctactaagatcatatcaaattcatcattatgttttcgccaaaaatcaactgcttgatctttacccattataaatagtgaagtcgataaaccatcagctaaagtcccatcttcactaacgatcgtaactgatttcaagccattattagcaggacatcctgttgcaggatcaatgatatgatgataagtaacaccatcttgttcaaaatatctctcatatcctccagaagtaattaccgcacaatcttcagcctgcaatactcctaaataatctgtgccatcaggatcttgaatggcaacgcgccatagatcatcatccgtttttctacctaaaacctggacatttccacctaaactaactaatcctttagtcaccccatttttacgaaaaatatccatgatccgtgatgaagtatagcctttagcaattccccctagatcaatttttaatccttctttttcaaacgtaacggtagattttttctcatttaattttattgctgaagaatcaactaacgttaaaagctgagacaatacttcattgcttggaactgtaaaattcttatctgtaaatccccatgactgcatgattggataaatcgttatatcaaactttccattagtttctttccacaaatctaaagaacgacttattaaatattcagtatcatcagatactttaccgcctccattgtcatttaaagaagatacttcactatttttatctcctgtagataacaatgcatcaagtctctcaatttcatcaactgcttcatccactgcgttttgagcattctttccatatgcagtaactgtcatgtaggtatccattgcaaaaacatcttcactaacaggttcttgagcggtatcatcctcagttgctgatctaccactacaccctgtaaaaatcagacatcctagtattaaataagtaattatattcttctttgtcatataccctcccacggttagctttaactaactttttttcactgacatactatcactccaatattgatgtgtcaagtaactattttacttttttcgataaaaatttattatttctttgcagattatttatttttccccaaaaaaagaactgttgaattttactatcaacagtccttaaaatcattatctattaacttttttctttttaaaattattactactccagtaaagaacatcactgcaaaacattgatttatcacgcttgaatccccagttttaacagtacttgcttttttagatacatcattagatttatttgatactgtatcgatatctaaattattaagtaccagctgtaatttattcacagcattatttacttgttcttgatttgtttcaggatcatctaagacaagctgtgctttatttaatgtttcagttactatatcccatgtcttagcactatattttgtactatttaatccctttgcctgattgatcagttcttgtaatagttctttatttggttttaatcttaactctaaatatgcttttgttagtgcttgataagctgtatctacagcctcctggctagccttttcatctattaatactgtttgtcctttttctaatactggtaacattacctgccatgatgattcgatatacttactttcatctaaactcaatactttatttaccattgcttctaaatatgtcttgtctacttttttaacttcaactaaactgtcaattgcaacttgaagatcattatatacttgatctacttcttcctgcattgcattttcatcactcattactgcattggctgcttctaaggcttctttaaatgccatccatgaatctggaatatagttttcttctacataactatttgcttcattgatcaaagcttctaaagcactcttatcaccttttacaaattccaacatctgcatcgcaactgataagcgagcaaatgaagcattgatagtttcctgactggcactatcatcagctaagattactgttgcttcttgtagcgctgctttaaattcattaacgacagctggaacaacattaactaactgttcttcagttatattatttgccatttcaacagctattgataatgctaatttattagttttaattactttttctattaagttttcaatagcatcatttaaattcttaatggcatcatcaacctcttgtttagatgcttctaagttttgataaacgatttttgcagcatttaaagcgttgtttaaattttcaacactagtctcttcatatttacttaaatctttttcattacataaaataatcaaatcatttaattgttctttatattcacttttatcaatcaatgcattaaatctagatatcaataattgtgtaagcatatcaatctcttcttgattatctgctacttgatatcttgccactgcttgatcatatgcctcttgataattcataaccgtttctataaaatacttagataaatcaatttctttaaactttattatttcttgagctaaatcatgataatctaaagtttcttcttgactgccgcttgttacttggtaataatcaaaagatacttttggtcttgatccagctggggcattttctggacaatctcttacaattacctctactgtatgattaccatttgataacgttagatcttcaaatacgtttgattttggttcacttccagagactgtcgtaaaagtagaatacaatccttttgaaattccatcgatctttacctcaatattagctccagcataaccgcccgctgcttcaagtttcatgaaatataacgctattcctgttcccttaaaatcaaaattaaaacttacatcttttgttgttgattcagttactgtcccattttcatgtttagcttcatcccaagtactccaattgccgatatatataattgaactatcgcgatcatcatatttagtagtagttacagctttagtaactgtaattattttttcagcttttatttctggattaattttatcaactgcacaaacaacaactctgccaacatcatcaacagttaataacccctcatcgctaatgctggcaatgtttgaaggtaaatctaaatcattttttacactccatgtaacttcattaccactagcacctgctggtagatattttgcctgcagctgtattgtattagtttgatttaaattaattacatcacttgatgatatgatcgtaagaccagtcggtgggactgcacgaataatttcaaaagcatctaaagaaatttttgcttgttttacaacaagtttcactttatgaatgccctcttctaaatcggttatttctaataacagctgctggcgcagagtttgagagctgttagtatcaacatcactagctactatttgatcatcaatatacagatcgaaagtgtgcgtgtcattagctttcattccaataacttttaaaccggtaccagaaaaataaaattccatcgtatccccgttggcatacgtgtatttttcagtgcctaaatattgaccactatctaaccagtcaccccagctgcctgtataagtaattaaattatcgcgatcatccatcttttcgatatttccaatatcgactggagttaaaacagctgtagttttgccttcaccactatcaacaaccgcagccactttatatttggaaccatgatgataagtatcattaaatgatgttgtcttaatcgttgcaatttttacatatgtttcattatcatcactacgatatatattatatgaatttgcatttgcaacatcatcaaaagtaactaatgttacttttccatcactataaaccatcgcattttctggagctttaactggtttttcaggtatatcttcaattatatatactttatttttttcagtattaaaagtaattttattatcattctctttaacaaaatcaataatgtttccagcagtatcttttaacgttgctttagaaatattaggatattgaagtgaacagctctgtccattattagataatattgacgctttcgttaaattactatttgaccaatccatagatacttcaaaattaccacgagctactagtccttcaacatgtcctgtcaaccaaacatctggtaaagctggcaacatattgatgtatcccatattactttgtaataacatttctgcaactccagcagtatatccaaagttaccatcaatttggaatggggcatgagcatcccaaagatttggataagctccgtttttaaagaaggctttaataatgtcgtaagcgtgattgccatcaccaacacgagcccaggaatttaatctttgtcccattccccagccggtagcgtcatcaccacgatcttttaatgatacaatagcagcatttaaataatcttcattatcaacactaattaaatcaccaggaaataatcctaataaatgtgacatatgacgatgtttacgatcactgccactgacacttcctaaggttgtttcgttataccattcttttatttgtccatcatcaccaatttcaattggatttaatttgctttgtaagttttgccattgagccactaaatcacgatcaacgcctaatacgttagctgcctcaacagcatctttaaataactgccatactaatgattgctcatatgtatttccggctgtatatggtccatgttctggtgaatacgcaggaacagtaaccattcttcccgtcactggattttctctaagtatctgctggtataattttgcttcttctttaagcattggataaatcttatcagctaaatactcaagatctcccgtatattcgtaatattcataacaattctgtaagatccatggcactgctgctggtgaccagccccagctaaatgcccaacctggacaagtccagccaaatggcgtattttgagtatgcgctgtaaagccattttccggatttgcttcatcactaacgaccccaaaatatgttgcagctgtaactcttcccggttcccgaagggaatctacataatcaattaacggcgtcgcacactcttgcatattagtaacataagtaggccaataattcatttgtagattaacattcatatgataatcactagcccatggtacacgattttcatcaccaacgcgattattccatacgccctgtaaattagctggtaaatcaccatctcttgaagaagcaatttgtaaatatcgaccatattgaaataaaacagtttctaaagctcgacgttgggcttcactagcgctgccatctttatacgcttctaataatgtatccgtaggtttgtcagatacactttgtcccaaatttaattcaactcgattaaatatctcttgataatcatttagtgcgttttcttttactttttcatagccagcttgataagccctatcgatatcatcgcttacacgctcatttaactgagcatcggtttcattggtacgataagctgggtattcatttttataatcagtcgaagcactaacaaaaatatgtacttcactagcatccttgatcgttaatgaatcaccattggcttcaaccctgccatctacaggatatacttttaactgtccgtttaattttaattgattatcgttcatttgaccactaactgtaattttgttatctactgctgtagtaactacatttttttgtaaagcagtcgttgtgtcattatcaattgggaatgatacttcaaaattcatcttatcattagccataattttcatcgcaattacattgtcgggataacttgctaaatattcacgatgataatccgtaccatttaatgaaaaatcaacacttgccagtgaagtatttagatcaagttcacgacgataattttcaacatcaccgcttaaattaaaatctaaataaatatcaccaaaagactgatatgctccatagccctctttcaatccaataatttgattacataacgaagaagcatcctgaccacttaaaaaagcatcttgaacactttttacataatcagccatcgcttgatttcccactgtatcaatatttccaccgttataattaggacgcgattcactaggacctcccgtccataatgttttatggttaaaagttaaatgctctctactaatttcaccataaacattagcgcccatataagaattaccaattggtaaacttaactgttgccaacggttatcttcttcagttgtcccaaaaccaccttcacgtcctggaatcaaagttccttgactaacaggttcatcaaaataaagttttaatgcttctttaacggttttagaatcagacaaacttttaaaatctgatttagcttgtaaacttcctagcggcaaacaaactaatatcaaaaccccagcaagaagcactttaaataattccgctgctttcttcttaattttcatttcctatctctgctctcctttttcaaatcatatataaagccatatccgcactaaaaatgtagcttttacatatctattatcatttaatcatacatttttaatgtaaacaaacgatatccagaaagtgagtaattttttcaatacattcaataataaaatacccctcatttattttttaaagcagataatagttttaaatagatccccatcaatatcgatcttaaattccccgccttgaacttcagtaaaactttttgcaatcgctaatcctaaaccactgccagtttcatgcctcgatttatcgccacgaacaaatctttcaacgatttcatcagctgtaaaattcatctgtgtagccgagatatttttaaattcaaccactattttattgacatcatctttaacttcaagatagacacgactattgatcatcgcgtatttagcgatattagtaaaaagattttcaaatatgcggtaggttttatcaccatctagttttaatttaatatccgtactttcatactttcttattagaattaaatttttagcttctaaaatctctttactttcagtatatgtctgttctaacaatgcaataatattaagattcattaaattcaactgaatgttaccactattgattttactaatttcaaaaaaatcctcaattagcgtagttaatctatttacatacaaattcaaattattcaaatattcatgccgcgttttttcagtaagtaaatcatcctgtaataatacaatataattttttatacatgttaatggtgtttttaaatcatgggacacattactaatcagctcatttttcatattttgagattttatttcttcttcaacagcttttttaaaaccatctttgatattattaaattcaatctctaactgattaaaaacgcctaaatcagcctctatctccatatcaaaatttccttttcccagttcttgagcggcttttaataagcgattataatctttttgaatcttcattcctttattttccaaccaaaaaaaagtactaataagataaacaaatataaatatataattatttaaaactactaataagatgaaaataaatcctgcattaataactacatattttaaaatcatcttatttattggaattaataaatctatttgtataaacatatttaatttatcttctacatccataaagaacattttaaaataatctttaataacatgaatatatctaaaaccaattaaaactattattaatccgccaactatccatagtttaatcagaaaacaatttggaacctttttatttttagaaataatataaattatttctaaatttttaggacgattaatttttatcttattaagaaaatcactatgactatccatgcgataatggatgcgtaaaagtttttctaagctaaaatatgaagatgactcattatgtatattaccttctttttttaaatccccattttcatcataaaacatcacactataaaaataatatttacttttatcatcaaaatcatcttgattaatattatttgatatgattttatttgtttttgtattttttattgaataaatgaaatcatggtcgttttgaaaacatctttttgtataatccataatattataaaatttattactgatctgccacttatccttatcagggatagtttcatcaaaaaataaaatttcatattcgggatctaatttttttgccattgctagtgtgaaatattgaaaatcttcatttaaataagacatcttttctttatgtttttgcaaactaatatcttttcttagattatcattaaacaataaaataagaattactaaaatcaaaagaaaaaaaataaaactacatattcgttttaacacaatcataatttcaccgatactttttcaattttataaccaattccccataccacttttaaatactctggttttttaggatttatttctattttttctcttaattttctaatatgaaccatgatagtttctgtatttattgcttcttctttccagactgcctgataaatttcttcagcagaataaactctccctggataactcatcaacaattcaagaatttgaaattcttttgctgtcaagcgaactgttttatcattgacgattacttctttagtgtatttatcaagttcaagtcctccaacgataaggcggtgatcattatcgctagaaatcgacttattttttaataacatgatctgatcatatcttctaatatttgcattaactctggcaatcagctccataggttcaaaaggttttgtgacataatcatcagcacctaaatttaaaccagtaattttatcaatatcttctgacttagcacttaaaaaaataattggaaagtcatatttttgccgtaattttaaagtcatcgtaatcccgtccatcactggcatcataatatcaataatagcaagatgaatctcattaatattaataatttctaatccttcctgcccattggtggcagcaaatactttatatccttgattttttaagaatacgcttactgtatctcttattccctgttcatcttcaactattaatattgcatgttccataactcatttcctttctcagtaatatttcagtatgatttatgtacttctttattatgaatgataaaaataaactgaatatattcaaaattcttaaaaaatccttaaatttcattttatttctaatcttaatgtttaaaaactgcttgtatcactatcctttaaaaatataaataattaattataaaaatcagataaaaaagcctgtaaaacaagtaatcaaatattttatcattaagaatgattgcttgattattcaactactttttacaggtaatacgatattaatttctttattttaggtaaacgtaaaaaaagagatttttattaaacctctttttatataaatcaaatagatattaaataatatattacatatgatctaaccctgtttattctgatcttagcgctgttacagcatcttcttgagcagctttttttgatggaatcaacccaccgataagcgttaaaacaacacttaaaacaattaaaataattgctcctgcaattggtagtgcagcattaagactagtattaccagctagatgatgaataaccatattacctggtatcaacaataaaagtgtgattcctatacctaataaaccagccagcaagccaataataaatgtttccgcattaaatacttgcgatatattgtgctttgaagccccaatagcccgtaagatcccgatttcttttttacgctctaaaacactaatataagtaataacgccaatcataatcgatgatacaactaaagaaatagcgacaaatgcaactaaaacataactgatcatattaataatatctgtaacagatgacattaaagcaccaacataatcggtataagtaataactttattatcatcaattttttccattcgttcattataactatccaaaatattaataacttcctgtttactttcaaagtctttaggataaatatttataccgcttggtttatcaaattctgcgtattgaagcttacttaaattattatcataagaagttgtttcttttgacatcaacgatatcatcaattcagataaatcttcttcattcatatttacttttattgcgttagcaaaagcattagtgtctattgagatagcattttgcatatttgttgccaattgccccatttgtttatttatttctgtgcttaattgttcttgcagtgatttcatcaaagtttcactatattgtctcactgctgcttggatttgaacctgtagttcgttttgaaattgagcaaggagcccgctttcttgtaaaatatttgtcaattctttttgaataagactttgtgcttgagatgtttgaatataagttctaaaatattctgttattttttctggatcagttaaattattttcagtagtatagttttgaaaatctgtcacgagtgtttgcatcaaagaagtaaactgatcattactaaattcaatttttatattcgagaaaaaattgtccatatttattgcaggtaatgaattaaaatctaaactaatattacttagatccaaaccactaggatctatttttagtttattttgatcaatcgtaaaagcttttttcaacatttcagtatcaacggtaaataaagactgcatatcaaatttttgttcattttcttcattttcaaatgattgtccagtaaaaacattaatattcggatccgctaattgtttttttactatttcacttaatgaagcctgctctataacatgggtagttaaagaagctggataaccaataccattgtttaacatcgttgcactagccccatcgcttggctggacgatcccaacgatagttaagtcttcactattattaataagctcgcgcatatatgcttcatcgtcagttttatctcgataaacaccatatgtttcatcatatacataacaattagaggaatctacaagtttaaatttagtccctaaaacatcatcataatcatatgatttaatatcatcaggtgtagtaacttcttcttcacttgcaaattgctggatcatttcatcaagttcatcataatcacgcaatcctaatgtataaagcatcaaatcacttatcttcccacttcctgttaagaccaaaacacattcattatatttttttggccatcttccagcctttacatcatattgatcttcatataattttgaattacttggcatttgatagaaaacatctgtactcatcatcattgacatcatactattggaacttgttgatgatcccaatcctaatgctgaaaatgatttatcgggattaacctgtcttattttttctgtattagaactataaatttgtggtacagcattatagctatattctatcgaatttgtatatttatcaacaccactattaccttgatctaaatatgtctttaaagatgctaaatcattcgaaccaatctttgaaaacatatttgtaatcatttgtgcaacctggattttagcttcgtcatcttctttttgattattatcctgcgtctcttcaactaacatcgaagtcaaatcaataccactgctttgaatctgtaaaggatattctgataacgtatcttcttcaatcgttttaatatactcatttacaccattagaaagagataatattaaagaaattccaatgattccaatagaaccagcaaatgaagttaagatagttcgggctttttttattttcaaattattaaaactaagtgataaagctgttaaaaaagacattgatgatttacccatattttcatgcctaggtgcttctaattcatcttcttttactacatacttattagaatcagaacgaattacaccatcacgtaattctacgattcttgtagcatattccttagctaattcaggattatgagtaaccattacaaccaaacgatctttagccacttcttttaaaagttccatgacttgaacacttgtctcactatctagtgctcctgtcggttcatcggctaataaaatatcgggattatttatcaaggctcgggcaattgcaactctttgcatttgtcctcctgacatttgatttggctttttatgtccttgatttcctaaaccaacttgttcaagcgcttttttagctcgttcttttcgttctgcttttgatatacccgatatcgttaatgctagttcaacatttgataatactgtttgatgaggtattaaattataactttggaaaacaaatcctatcgtatgattacgatacgaatcccaatcccgatctttatattttttagtagatatcccattaatgatcatatcaccactatcatagcgatcaagaccgccaataatatttaaaagtgtcgttttccctgagccactaggacctaatattgctacaaactcattatcacgtaaatttaaactaacaccgtccaatgctttttgtactaaatttcccgttttatattccttataaatattcttaacttgaagcatattgcatcctcctatttttagtatacatcaacattatatggttcaaaaataaactaaagataaacacaaatataaaattatattttttctaaaataacttaacttcccatcttcacacatattttattatcaacacgttattaatattatacattttttatttactgatcataattaaataaattcttctgcatccaaaacttgatatcctgcctggataagagctttggcaaataaaccttgtccagcgatcaatttattagtaaaacttccatcataaatttgattaactccacatgtaggacttcttgattggagaataactagatcaattttttcatcctttattttttctaatgctagttggcatgctttttgataactagcatcaacattattaccatcaatatcagtaacaaccccctttacgatttctgcacaaggacgaggaatcgtcatatttgctagtaattctggacatatttctataacttctttgtcttctaaaaacttgatgaccttactgttaagattatttccaccattgtatttgcaatttctacccaatatacaagaacttaccaataccttcattattaatcacctcacatttaaaaaaattcctttttagtataatacaaagatatcaaaaaaacaaaaataatcactaaattataaatattagttttggaaaataaaaaattttcattctatgatatattgttgctttggtgaacaccaaaaacaaatagacagtattatattcgagagttagaaaacaatggtttcatttccataaaagtatattctgttcacctaaaacaaaaagacctcaaaaagctctattcctgtactagagcaatggatgagtagatattggatcatttgtcataataattgtaaaagggacaacataaatgtccctaggtaatattcgtttagtaattatcattttctatattttttaaacaagcagcattttaattattttgttttgcttctaatgctagcgctaatgctcctacaacaccagcattatcaccaagtcctggatatacgatatagtctttgattttatctgttgtcacttcttctttttgaatatattcatttaaaaactgctgagtataacgatgtatcataggaaaaagctgtttttgatgcatgaccccaccacctaagatgatctttttaggtgataagatcaatatatagttagcacatgcctgaccgatataatatgcttctaaatcccaggctggatgattttctggcagctcgcttcctttaactccccatcttttttctatggctggtccggctgctaacccttctaagcatgttccatgatataggcatgctccttgatatggatcatcatctctaacgatcattttcatatgtcccatttctggatgcaataaaccatgtacaagttttccacctaaaatagcaccaccgcctattccagttccaattgttagatatagtgcactatcaagtcctttagctgctccgaacattgcttctcctaaagctgcgccattgacatctgtgtcaaatcccatcgggatatcatatctttcttttaaagcacccataatattataatttgaccagcctggtttaggggtagttgttatatatccatatgttggactattaacatctggatcgattggaccaaaacttccgactcctaatgcttcgatatctttatcatcaaaatattgaaaaacatttgccattgttttttctggttcttctgttggaaatgatgcccgatcgataatatttccattttcatctccaatacatacaacaaattttgttcctcctgcttcgattgctcctagcttcatatctttgtctcctttttttctataatgttatatggtttcagttcataatagtccatggtcattggacaagaaacttttatttttgtatcatgataagaatcataaacacgtgtcgtcattaccttctgaccatgattaataaatatttcaagtgatgatatgtcactaaatatatctatttcacttatctcatttattttaacacatcttttatctctaccatagccgctttcttgtaacgataggatcaatatctttccatcatatcttaattgaagatcttttcttaaatcaatttgaaattcttgagaagttatttcaagatgaatttgacaagcatgactttgataatagtatatttctttttcaactaattctttatatagatgttttattcttaaattttttgtttcacgaatgggatattgataaatttgattatccttaaatgttaattccctaggaagtatcaatgcatcattccaattatattgaatagttggagttttataaggacaatcgggtattcccatccagccaacaagaattcgtcttttatcctggcttaaaaaggttctggcggcataaaaatcaaatccttcatcaaacgattgaaacctttctaattgataattatttctaaaatcaccatttaaaataaaatatccacattgatgattgttttcgtattcatgttgttttatcccttgaggacagcaaaccaggatttgctgctgggacagttcaaaataatcaggacattcccacatataacctaatttctcttcagttttaattctttgaataaatttccattcttttttatctttactttcgtaagcaaggatcattccctgatcatgaatgtctcttgcacctaaaaacatataatactggtcttgataaaaaacataaggatctctaacatgctttgtcatatcttgaggaaaatcggcatttgtcatcaataattgtttatcatcaaaatgaatataatcagcactttgaaccatcaaaacattttgttctctacctgccatgatataatcataatttccctgatgacgaacatttccagtataaaacaaatacaattttcctttttcataaaaaccgctgccactataaacaccatctctatcatatcggctatctggcaaaagtgctattggttcttgaacaaagttgataaaatcctgcgtactataatgtctccaaatacaaggaactcttccttttgttttaaaggcttgaggatcattaagataaaatatgtggaaggtatcttcgatttggcacatgccattaggatcagcaatcgttccttctaacggcattaaatgatattttaaacgatattcattatttttcatttttctcgatttgatagctatctaaaggatagtaagttaattttccttgatgacttgtatgaaaataaagatgctgtgataatgtttcactatacacccttgtcgtaaaaacttcttgtccaccattgacaaatatttctaaagccgatgtatcactccaaatatccaaatgcctaacttctttgatttcaacacttctttgatcacgcccacaaccgcttgttcctagtgataatgttaaaacatgatctttataattcaagaaaacatcatctcttatttgaatttgaaaatctttttgatttttaaactcaatatccatttcataacatacatcatcatatgatgtatcattccattgatctatatccatttcatatttttcttttcttaactgtttcatctcaactaatggctgttgaataatttttccatctttttgaatcagcattcttggcattgtcaaagcatgctgccagctatattgaatagtaggatcattatgataagatgcatctgggattcccatccatgcatataaaatatgtctgcctttttcatcaataaaactttgcggggcatatatatcaaatcctcgatctaattctttaaactctcccaaattgtattggttttgctcaaaatcatattctaattgaaaatatcccatctgataaacattagcataatcataaccattctgcccaactccctggggacagcaaatcaaaaataattgtccatctatttctaataaatcgggacattcccacatataaccaaaaggttgcggtgttgttatacagttataatactgaaaattttgtaaatcctggcttcgataaagtaatacacagccttggctatctcttgttcgggctcctaaaaccatataataatatttcccttttttaaagattttaggatctcttacatgttttgacatattatgaggataatcatcattatctaaaattaatttttttctacttatctccatgccatcttcacttgtaaaaaaaagcgtattttgttctctaccatcattgatataatcataatcatcacgatcatttaatttaacatttccggtataaaaataatatatttttccatcttcaacataagctgaaccactgtatactccatcacgatcttctttttgatcagggtataaaaatggttcttcttctttaaaatgaaccatatctgttgaagtatagtgaccccataatttaattccccagttacagtcgtatggtgtgtattgaaaataaatgtgataaataccatctttttgacataatccatttggatcattcagccatccagtcggaggcatgaggtgataatgtaaacgatttttatctttttttacattatccctcatattttgatgattatcatattgatcataataatctttttttgtcatcatatttttattcatcctccagttatttaataattgctactacatcttctccctttgttgctcctgtatatttcatttctacctgacgtccttcgtttaattcaaaaaccatcatcgtctctgtagaataccccttcttttcaattaagtcctgatcaaatgttaatagaacatccccttgtttaacttcttgatttattgctacaaaacattcaaagccttcaccatttaaattaacagtatctatcccacaatgaatgagaatacttgaaccatcttttaacattaaacctactgcatgtttacttggaaaaacaaatgagatctttccatcagcaggagcaacgacctttccttcactaacagtaactgcaattccatcacccatggctttagaagcaaatgtttgatcagtagattctgtcacatttttaacttcaccttttactggtgataatatttctatttcttcattaaattcaacagcgttttcagtaactttttcatcactttttacttcttttggttgaccttttgtttttccaagaataaccgcaaagataaatccaccagctaaagcaataacatgggcaataatatagttaatataaccattgtttgcaggatcacatatagcaattcctggcagtgctgtcgttccaaatcctaatgacgctaaatttgcaaaataaacatacgcaccagctaaagctccaccaatacatccaccaattaatggaaatttatatcttaagttaaccccaaaaatggctggttcactgattccgaataatgttgatgcaaatgatggtaaacataattctttagctttattatttttccaatttaatattaaatatcctaaaactgcaccaccttgtcccattaaagcaactgacattagtggatttaagaaatttctaccagtatcagcgataagctgggcttcaactgcaccaagaatatgatgcaaaccagtaataacgatgatttgttgtacgccggcaaaaaacgcataaccaagagcccctaagttttgtgtcatccatactaaaccatttgtaatagcacttgataattctctaccaactggtcctacgatcgtaaataataaaactgttgaaataaaaactgtacataacggtgaaaataacagcttcacgacatcaggtatttttttatcaaagaaaatatctaattttgctgtaacgaatcccatcattaatgcaatgatgattcctccttgaaaaccaacaagttcgattggtaaaccaaaaatccgaataacatctggtacgactgttccactaccaacagaataagcattagctagtgaagaatccaacatgatcgcacctacaactaaacctaagatcggtttcccgccatatcttttacacgcactataacatacagccattggtaaaatagcgaaaataccatttgatgctaaactgacaagcttattgagtgcaaataatgtttcattatttttgacaacatcccaatttcctaaaacacctgtaatccctgttaatagagctgccgctaggatacctggcatgatatcaataaaaacatcagataatgatttaataacagtttgaactggattttgttttttattactttgatctttaatatctcctaaagacatattttcagtatgcgtatagcgactaaaaacttcataaacttcattaacaagacctgctccaaaaataatttgtaactgatttccagcaataaataccccttttgctaaatctacatcatcgagcttttccatatcagccaaatcattgttctttagaacgattcttaatcttgtagcgcaatgtgcagttccttgaatattatccattcctcctacatattccactatctcttttgaaattcgtgaatacttttcttgtttcgtttctcccatttttcttctcctttttatattttatggtaccggttccttacaacatcaatatacactaattgtaagcgcttgtcaacaataatgtggtatcggtttcatatttttttataaaaaaagagaaattcatcatttctccatcttctttacactttctcctgggataaattgatatccaattatcgtctctttatcaacactttcacctttgatcaattgtataatcgtgtaaccagccaagactccagcttcttcattatcaaaacgaatcgtacataaactaggtgtgatcaattctgatatttcataaccaccaaagcctgtcaaagaaacttcttcaggcactttgatattagcttcttttaattctttaaaagtcgctaaagcaatattgtctgttgcacaaataatcatagaaggacgatgtctttttaataaattatgtacaactttccttgttttatcaaaagtaaaatctgtttctaccatttttacatgatcgataccatattctttcaaagcatccatgacacctttttttctgacatatcctactgcttcatcgtatccgccaacccctaagaaaacaatgtctttgtgatgattcttagcaacatgtcttccaatatcgtaaccagcatgataatcatcattaagtatagaaataccatcactgatcttctgaaacaaaaatacgatcggtatatcaagcttattcaataaagtatgatgtgccattgtcacatctgtcgctaataaaacgattccatcaactcgcatatgccatagtttctctattgacttcaattcttctaattcatcatgatttgtattgatgatcaacggtgtatacccctgatcttttaaataagcatctaatgacatcagcactcttgaagaagttattgatgttaacgtaggggcaataatgcctatgatctttgtttccttcgcctttaaactttgggcaaaagtatttggttgataatgatattcatcaattatttttttaattttatcgcgggtttcatcttttacgtaaccaccattaaaatatcgtgaaacagttgtttttcctacaccagccatttttgcgatatcctgcattgttaattttttatctttcattttcatccactcacttacaaaacattataacaaataaaccatcatatctctatagtacaaaaactcattatttaaatttttaattacattttttcaacgaattatatttatcagttataaaaacagcatttttatttttgcctctttctagatgacaatgcacattataatgattcatagcttatattgagctggtgtatttcacaacatttaatagccttagattatattaattttttagacctccttttatttagaataatcaataataacatttaatgcttcttcaggatacgaagctttttcgattgctttttttaattcatcaatacaatattcatgagtaataattgattctatatcccatctatgactttccattatcttcatcacatcttcaacatcttctggaaaatatccaccactaccaataagtgcttgttgagcataagtcatatgtaaaatatctactggtctttttccagcattaactgcaacaacgaccatacgactaataatcttgcccatatcatggaatatttctaatattgaatcaactccagcagcatcaatataaatatcaacatcagcggtagttccttgtaacgaaggcgcttttccaaaatattcgatagcctttgtttttaaatcatcacaaccattattacatacttcaaaacctaattttttaactatatcaagtcgaaagtcagatatatcacagaccatgaccttatcacaaccaaaatactttaaggctatagctgcagcaattccaatcgtcccagccccaaaaacgattgcagtttcattttcttttggttcacttcttcttgcagcacgacagcctacagtaaaaggttcaatcaaacaagctgcttttagtgaaatattatcactaattttataaatctgtttatttaatgttgcattgacaattggaatatactgagaaaatcctcctgttgttccagcccgtgcaggatctcctctagcaagtaacggatatggataaacaacatcaccgatatgtatatctttaacattttttccaacttttacaactttactaaccatttcatgaccaaattcaccaccaatagttaccttatgtccggtattaggaccatgtttataaacagccacatctgttccacagatagaggcatataggttttttacaagaatatcgttgtcacctattgctggcatttcaacttctcttatttcgacattttcttttcctaaataaattcctgatttcatttttatccccttccctttcattacgattttatttgaaaacgttcagactgataatgagctgttttttgagttttatcttttgtcgttgaaaatcttatcttatcatttaagcaataacttattttcaattcttttaataattgtataaatgatcgcacatatttttctgtttcaatattctgaataaaagtgatattaaatgactgcgatgtagctgtcatatttactgttatacctttgattccacctgaatagaaatgaatagcatcaataaactggttgcattcacctaaatcaaatgtacctaaataacttaaaacaaaactattaattgtcatcgtatcgtaaaaagacattattttttcttttcttccattgttttgagttgatctaatttatcattcataccactaaacatattcgctgtttgtttgacatagtttagatctcgctgtttagctatactttctctatattttgtgcataattcttttaaattcatttgattatctttttggtcgaatgaaagatacatacttctgacacagtttttgtgagtatgaggcaaccctaattcctttctcatatcagttgctatagaacaaacaataggtttatctatatttgaattattgatatatatcgattttgaaattaaataagacatcaaaatagccggtgttgcattgacccttttggcaaatgataaatactcctgagaatttatttctatttcaaaacgataatcttcatcttctatttgatgatcatattcgggaagtttaaaactatctttattaataagaggttcttcaaaagactgaacttcatattttttatgaaacagttctgctgtttcataaaaaacattgaatcagttgattttctgacatggagtgcatcataatctctattattaagtttaacaaaataataataaatcagtgtttcaacaaatggtttgattcctcctccatcacataaggcgtgatgaaatgaaacatagatgtgttctttataatagctaacctcaattaaatgataagaatttgataaacttcctaaagaacggaaagatttacttcttctaactgttaaagcaatattttgattatcagcaatataaaaatcaccatttttttcaactagtttacttgctagaaaggatgtcttttcattgcttcatttaatgcctgtgttaagatagaacctctgattttatttttttaatcacacatcaataacagtacaattcaatccttctttacgataaagaaaagattgtccagaacgtattttttccataatttactctccattttcatacctatctcattattatatatctaaataccgtttcatccttatttgatgatacaatacaattaatcccaataaaaaataccatcaaacatacagcaataccggatattaaatacaatatttcttcagatttaatatttccacttccaaaagaagctaccattgcactttctaatgataatacagatacacatgcatcaacataaccaatacttcgggttgcttttaataacggtgatttcaatttatttacggtaaaaagataaattaccgatgaaattcctttataaaaggtatatccagctacaataaaaataatatatccaggataacttttacctccttcaaaattaactaagagaactactgctcctattaatgttattgtcatcaaaatcaataaaatcccacaacaaaaatatatatttatttcctgtaacaagactcgctgggtacgtttcatttttgatatttttgattcagatctaataaccataaaacgcataatacttaaaaatatataataagctgataacgtaataaaccatggcgagcaatgcataataccaatgatcccattaaaaattgcaaatattatatttaaaataagactacagcttgtcataacaaaaattttatatcgataatctgaatgtattttattgataaacttatatctttttcatttgtaatatactttttttagaataaataacaatataataagttgatgcaataaatgatatagcggctataacataaattatgatacttatccattctgacaacatatgtgtagatacctgtatgagcgatatagttgaaaaaataagtgtaatgatataaagaagtatcctatacttaaaacttagtgcttttatttgctgtattatatgttttattttcaattttcttatcatgtaaaataaacctcagtaattaaacaactataaattcttaagttgaatagctttgtcacatatctgatctatttcatcatactttttttcaacataaggaatgactttttttcgttgcttttccatcaacttcttatttaagaagcaaggcaaaatccagccaataaaacctggaatggcaaatataatacatgggataactagtggcggctcttgaataactgcaaatgttgaaaatgccataaatatcgttccgatcattgctattgttaaaacaatagtaagtgcataagaacgaacagatttttgtaattctataatttcacagaaacaagaatcaagatttctttctaatcttgtaagctctgtcttattaacgatatggtgctagaataaaaactgtaccagttaaatggaagaattagcagtcctgtggtacaatgtcatgagttaattataagaaatgaaagaggtatatgattatgagtaaaccaacatttacagatgaatttaaacagggagttgttgactatgtactgcagcaccctgatgaatccaaggtcgctattgccaaacactttggtgttgctgacagtactgttcacaagtggcttaaagatgctaaaaataataatggtacaattaattccaggggcagtggcaactattccagtgatgaagctaaagaaattgccaaactaaaaaaagaacttaaggatacaaaggatgctttagatgtcctaaaaaaggctattggcatactggggaattaactaagcaggaactgtatgatcagatcaagaaaaaatctgacgctgatcctaaagcttcagttaccagtatgcttgaaaaattgaatatcagtaaatctggatattatgactaccttaaaagaaaaccatgtaatcaaaaaataagaagagctaaactagctgttagaatcaaggaaatacacaaggaatcaaaagaaatatatggagcacctaaaataacccagatacttcaaagagaaggacataaggttagtgaaagatttgtagggaaactaatgaaagaaaacaacattaaagcccactatatcaagccatatactaaaacaacaaaagactgtgacttttccagcagattacataatattctaaaaagagattttaatccaaaggcgccaaatgaagcatggtgtacagacataacttatatatacacacatgatgaaggatttgtatatctaaccagtataatggatttatattcaagaaaaataatagcctggacattaagtaaaacactggaggtggatgaggtattaaaatgtctggaaacagcaaagagcagaagaaaaacagccaatccagtagtaatacaaagtgacaggggaatacattacacatcgaggaggtatcgagagctgacaagggatatggtgtgcagctattcaagaaaaggtaatccatgggataatgcatgtatagaatcatatcacgcattaataaaaagagagtggctaaacagatttaagataatgaattatcatcaggcatatcagctggtgtttgaatatttagaaggattctataatacagtaagaatccactcacattgtgaatatttatcaccaaatgaatatgagagcaaatacatgttagaggaaactaactaattttcttacatttagttagtccgaaatcttgacataggaccaacctgtttctcaacatttaggaaatcaattactctcatatacacataaaaataatattttaattattgaagatgattataatagaaagttgacataccactcaagagatagatattctaattcttgaatttcttttgtgattttctttatcgtcttattcaactccattccttataaaaaaaagaacaacttcatacgaagctgctcttcttataaattccaaacttattttaaaaaatatatcatctacatgatctttagtataatcagtagcaattaaatttattccagtaagcgccttaataagttctctaacttttaattcactttgatgatcactaaatctctttttccattctacaatatattggtatatcatattttcagtcacttcatgatatgtttcttttaaattatcaaatgaaaataaaatagtcgtaatcaattctgcctgatttgtatccttcactcttttaaataattgaaatgttttatttacattttcaatatcttttttgtgaatataataatttatctatcttaaaatctttacttactattataagcatcatttttccatattctttttcataaataagtaataaaaagagttaaacatacaaaaaaagaaaggctcactggcttgacggttcttactcgcttatgggtaaattgaacctatatccaaacatctcctttaatttttagcctttcttatacaactgtcttaagttgccgatattgtgataaaaccttacttttttaataaatcttcataaattgctacaattattttttatttaacgacaatattaacgattttattcttaacaacaattattttaacaatatttttaccatcagtatgcgctttaacattttcctgttcaaaagctgttttcttgactgtttcatcatcggcatctttagcgacttggatttttgctctaagtttaccatttacctgaacacccatttcaacagtttcactgactaacatactttcatcatatgttggccaaacttcgtatgcaagcgtattttcatgtcccaataattgccacatttcttcacagacatgaggtgcaatacaagaaagcatcttaataaaattaaatgcatattctttatatactgaaggtgctttataacattcattaataaagatcatcatctgtgaaatcgcagtattgaatcctaacgtttcaaaatcatcagtaactttctttactgtttgatgatatactcgatccaaactatgatcattttcatcacttaatttatcttgttcaataaataaacgataaacacgatctaaccatttacgagcaccatctaatccattggttgaccaaggaagagctgcttctaatggtcccataaacatttcatacaatcttaatgcatcagcaccatgactagcaacaatatcatcaggattaacaacattaccacgtgatttagacatcttttcattgttatcacctaaaatcattccttgatggaataatctttgccatggttctttacattttacaaccccagcatcatatagtactttatgccagaaacgtgagtataacaagtgtaataccgcatgttcggcaccacctacatataaatcaactggtaaccatttttctaataattttggatcacaaatagcttcactattatgaggatcaatataacgaatataataccagcatgatcctgcccattgtggcattgtatttgtttcacgacgtcctttttgaccatcaatttcaacttctaaccagtcttcacaatttgcaagtggtgattcaccactgtcatgtggttgaaagtttttagtagctggcaattctaatggtaattcttcaacaggaacagttttcattgttccatcttccatatggatgattggaataggttctccccaataacgttgacgagaaaatagccagtctcttaatttataagaaattttcttttcaccacattgatgttcttctagccaagcaatcattttatcaattgcttcttgttttcctaaaccatctagccactgtgaattaatatgtaaaccatcttcagtatacgcagcttcttcaatatttccaccttctaatacgggaataatatcgataccaaactttttagcaaattcccagtcacgatcatcatgagcaggtactgccatgattgctcctgttccataacttgctagaacataatcagagatccaaatcggaattttctttccattaactggattaattgcataagcacccgtaaaaactccagttttatccttatttaattctgttctttctaagtctgatttactaatgcagctttgtttataagcttcgattgctgctttttgttctggtgttgtgatttcatcaacatatggatgctctggtgccataacacagtaagttgctccaaataaagtatcacaacgagttgtaaaaactgtaaaaatcttatctgtcccatctattctaaaatcaacatttgcaccaactgattttccaatccagttacgctgcatctgttttgtagcttccggccagtctaaatcgtcaagatcttctaataatctttcagcatattctgtaatttttaagacccattgacgcattggcttacgaattacaggatacccaccacgttcacttttaccatcaataacttcttcattagcaagaactgctttaagttctggacaccagtttactggaatttcatcaacataggcaagtccagcatcatataacttcgtaaaaatccattgtgtccatttatagtattctggatcactagttgcaatttcacgatcccaatcatatgaaaatcctaatgatttaatttgtcctttgaatacttcaatattctttttagtaaattcagctggatgatgccctgtctgaatagcaaattgttcagctggcaaaccaaatgaatcaaatcccattggatgtaatacattgtatccttgcattcttttcattcttgaaacaatatctgttgctgtatatccttcaggatgtcctacatgaagaccatttcctgatggatatggaaacatatcaacacaataatattttggtttactgtcatcataacaatcagttttaaatgtcttatgttcatcccaatatttttgccattttggctcgatttgtttgtgattaaacggcattttataattcctccttaaaataaaaaaagccatccctctaaggacgactcaaatatcgcgttaccaccttagttcaaagtcacaaagactaagccctcaaaactttaacgcagttaacggcaacgactactctattcaccgctgcatctcctaggtgagttcataatccgttctatcagttttcaccacccactgactctctacaaaaaacgtcaattattactagtcctattcattgatttttttagatactcaaatattatatcacaaaaaagaccagatgcaacaaaattccatcatttaatatctttgatatttcaatgattttacaggatctaaacgactagcaaatgaggctggaaagaaactactggcaagtccaaaaaacaccgcttctaaataaataaaaactaataatgaattatctatttgaataaatgtctctgataaatttaattgtaacattacttcaacaaactggttaaataaaccaactaactgatcaaaaaacaaatatgaaaataaaaatgcaatattgatcaaagtaaaactttcaaatatcactaataaactaatttgtaatttacttgctccaaaacatttaaatattccaatatctttagtcttttcaaccgctgatagatataaaacttcaccaatcaaaaaacatgctgcaacaatagctaaagaagaaaataaaattaaaatatgttgaatctgtgataacagatcatcaactctagtattaatatcttcaccagctattttaaatttaaaatgcggattttcctgctttaaaattttcaaatattcattaacactaactttattatcaatgttgaccatcccaagcgaaaaaacaacttgatcaacatctacaccaaagcactcacttacatgtttaacattagccagctctttaatataaattgtatcaaataaagaattctcatcactaattcctacaacttttaacgttattttcttgatcacatcatcatgtaaataatatccataaatttgtttatttaaaagatctttataattctgctttaaatgtatggcagtagtttttgataaaacaatttcattatcacttctaatttctcgtcctaattctaatttattatttttaagctctttagtcatatcactaatatatactgtcttatcaacttgataatcatcttgcagtgatactcccataaattcataatcattcatttccccatataaatatgtaatttttgaattttccttcaatttaattagatcattataactgattacttttttattactagattgtaatgatacgagctgattaggaaaaattttatttaactgctgatgaatttgattttgcaaagaaccgctaaatgtaaacgtaatcataatacaaactagtgcaatcatcaaaccagtagtaatttttacatttctagcaatgtttgcacaatattgtaataaagctaatttgtaaagatttagaggtctttttttctcttttaaacgataataaaaattatcttttttaatatgggtctttttaccagccaacttgccattttgaaaataaaatatctgactggcatatttaaaagctaactcttcattatgagtaatcacaattactaaccgttctttagcctcctgtttcaataaatcaaaaattatttttgcattattatcatctaatgaaccagtcggttcatcacaaagtaaaatatcaacatttttaatcattgcccttaacattgcaacacgctgtttttggcctccagacaatattcctggtttttttcttaatatatcagttagctctaatttactttcccgatcttctctttcccttttaaaaattatttttgtgaaaaattgcgataataaatagttttgttttacatttaaccaattaattaaattaaaattttgaaaaataaaaccaatatgtttacgacaataattctttatcgttctaatattttgatgatcaaataaaatttcaccttcataatcctgatcaattccacctagtatatttaataaagttgtctttccacaacctgattctccgacaattacaatcattccggtattaggaaaaataattgataaatcattgatgataagttcatcataacgtttagatagattttttatctctaacattttaatcctcctttaaaagtacactaatatccattttcctgatttttaaacttgcccccattgctaccataaaacatgcgctcatataaattaatatcatgactaaatatagatcgaactgtgataaaaatagtttaggcaaaataaataaattagaaataccaaacaatttatcaccaacatcaaagaatcttattatttgtaggatcatctctgccaaaatagatccccatgctcctatcaaagctcccatcaaacttgtttcccagccaaataattttcttgctttgtttattgttaaaccatttgataacattaaacaaatatctctttttcgctcaatcaggatcatttttaaaacaatcgaaattaaaattaatgaaattataaagctaataactaaaaaaacagtaactactattactgccattttaaaaagaatatgataactatcgatataatcctgatgtaaattggtcacaaaatactggtgatcatattgttttaaaagctgatcaaaacgattactttttataactaaacatcttcgatcgattatttcgttctttagatttgaatctaaatatttttcatcataataaatatttgctcccgtatttatatgatcattgataattgctttgatcgtaaatacatactttttttcatcgatcacaaaatcaagtttatcagatatctttaaattatatactttagccgcttcttgattgatcatgatttgattttcttgattaaaataatcacctttttgataatcgatattatcatcttgatatatctgataactatttaactgtagttcctgatcattttttataattcctaaattaaaatccagcttataactaagctggctaactaacttattattttttaaattactgatctgttcatcagtaaaatttagttcctgataatcttttttactaatttcaatgatttctttaagcggattactgttaaaacaattttgtaaatataaccagcccccattaataccacttaaaagcagcacaaaagcacaaattgtaaatatttgagaaaaaaacatcattaaaatttttttcttttgataaataagctgtctttttacataaaattttattctaatcatattatcgttcatacttttaaaaaaatatttatgataattattttgatgaccaaaatcataattattctgattactttcaagattgataatcttattagtatacttattaatcaaattataattatgagaaataatgatgactaaatgttttctagaataccattttaaaagctccattacttctttagccatttgactatttagcgctcctgtaggctcgtcggcaagtaatatcggggtatcacaaagaaaagctctgatcaaactgactctttgcttttgtccgcctgaaagctctttaggaaaatattctaacaaaggggttatagctaatttatcagttagaaaatgtaatttagacatcgatatctttttaccctttatttttaccaataaaattatattttcatatactgttaacgcatcaactaaattataaaactgataaacataactaatatatttactttgatatttgtctatctgacgataatctaactcatgaccatcaatcattactttaccattatcagctttttcaatgcccgcgatcaaattcaataaagtcgatttaccacaaccgcttttaccaacgattgcaaccattcctacacgcggaaaattaattgaaagatcttcaattactaattgtttatttttaccaaatttataaaattttgtaacatttttaagttgtaataccatatttttctccttatgttataatatcttaggtgataaaaatgaatctatttagatacagtaatgataataaacgttatcatacttttaattattatttaaaaaacaaataccatcataaagttgccaaggtcagtcttaatgccggctttacttgtcctaatcgtgatggtactaaaggaaatggaggatgtattttttgtagtaacagcggttctggtgattatgctggtaacgttaaagattcactcgaacagcagtttaatgatgttagcgctattcttcaaaaaaaatggccaaattgcaaatatattgcatattttcaggctaatactaatacgtatggtccaattgaaaaaattcaaaactgcgttaatccttttttaaataaaaaagacgttgtagcaattagtattgccacccgtcctgattgtttagaaaatgatgttttagaatatctcgccaaaattaatacccagtgtgatttatgggtagaattaggattgcagactattcatgataaaacaggtcaattaattaatcgcgggcacacttatcaagaatttttagatggtttaaataaattgcgccagcataaaatcaatgtttgtgtccacataatcaatggtttaccctttgaaacaaaagaaatgatgttacaaacagctagagagttgggtaaactagatatccaggcgattaaaattcatatgctttatgtcattaaaaataccaaattacatcaactctacttagatgataaatttaaaatgctttctcgcgaagaatatattgatttagttactgaacaattaagttatctgcctgataatattattattgaacgtcttaccggtgatggaaacattgaagatttgattgcaccgctttggtcaattaaaaaagttactattttaaatgatattgataaattgatggtaagtaaaaattattatcagggatgtaatatccacttaaaataaaaagccctttgggctttttattattattcatcagtttcaattaaaccataatctccatcgttacgacggtaaacaatactaatagaatcactttcagcatcacgatatacgaagaatgaatgtccgatcaattccatctgcatgatcgcttcttccatatccattggtttaggagtaattgattttacctttaccaatacatcgtcttcagattcaacatcttcaattgaagatagattgaatgcaagtttattatcttttgatttacgacttaatctagttttgtactttctaatttgtccttctaatttatctacaactaaatccattgcagtatatagatcatcatcaactacttctgctcttaaaagtacatattcagtaggaatcgtaacttcaagtttttgaccataaggataaacccgacataaaacttttgcttctacattgtcacttacaataaagtacttatctaatttagataatttttctgatatttttgtttctatagcttctgtgatttcaatgttttttcctctaactgagattttcataagaattcctcctttgtgtatataaatattatacaatataaattcataaaataacacttaaattatagataaaattttccttaatttaacataatcaaaaaaacactcgattcatcgagtatttttatctataaatatttttttaaaatttctactttatctaacttttcccaaggtaaattaatatcgccacgaccaaaatgaccatacacagctgtttttaaatataaaggctgccgtaattgtaatgatttgataattcctcctggtgttaaatcaaaattttctttgatagctcttaaaataatgtcatgatcaacccgctcagttccataagtttccacaaaaatagaagttggttcttttaccccgattgcatatgaaacctgaatttcaatcttatcacaaagattagccgcaacaatatttttagcaatatatcttagcatatatgcagctgaacgatccacttttgaaggatctttaccactaaacgctccaccaccatggcgcgctgctccaccatatgtatcaacaatgatcttacgacctgttaatcccgtatcgccatgcggtcctccaattacaaaacgtcccgtaggattaattaaaacgcgataatctgtatttaaattatatttctttacaacgacatccatgatttcttcttttacgtaacgtttaaattctgcttcatcaaaatcaggatcatgctgtatcgacattaaaattgtatcaatcgttggttgttcttcagtataatcgatcgttacttgggctttcatatcaggacgagcatgtttaaactcgccactatttttcttttctgtagcataacgtactaagtgatgagcaatagaaattggtaatggcatataacctttagtttctttacaagcaaaaccaaacatgattccctgatcacctgccccaccaactgcatcattagttcctaaagcaatgtctggtgattgacaatctatttccaattgtactttacaagtacgataatcgatccctttttcgctatcatcatagcctatttcttttaaaacatcacgagctacttgttcataatcaactttagcagtcgttgtaatttcaccaccaataactactagatccgtagttgcaaagacttcacaagcaactcttgaattaggatcttcacttaaacaggcatcaagaatcgcatcgctgatttgatcacaaactttatcaggatgacccattgatactgattctgaagtaaataatactttttctttcattttctttctccttcttgtaaataaaaaagcttcctaaagagaaagcatacatagttaggaagccttctctcattgttcaagtaaaacttgctcagtcaggcaccttctatttcaaatatagggttgccactacatcatcgatcttcatctagtagttcttaataagagtcttttttatttatttcttgtatttcttcttttgtcagcgacgtcataatttcaattaattcgtcatctaaaccaatatctaataagatactagctatcattttctgttgtctaacattttcctgcatattatcacctaaacatagtttgcattgtttaaacaataatattctaaaaaagcaacaaatacatcataatatatctaataaaatattgcaagtaatttatcagatattagcattttaacatgaattatagcgaatttcatctcaaaattatatcagatttgtctcaaattaaaatgtcataccttctaaaacattttgaacacctaaaacacctggaacttcttccattaaaatttgttcaacaccatctttcaatgtttcatcaagcattgtacatcctgcacaagcaccaagcatttttacataaacgatcccatctttaaaatccaacaactcaatatcgccaccatcgtgatttaaatatggtcttaatttattaattactttttctacttcttctattgtacttgtattttccatctttaacatctccttatctgatactttattctaccacaaaatttttatttttaaataaaaatacacgataaacttattacataaatatttttattttaaaattcatcaataaaaattattaaaatgaaatatttttaatcattttatgatataataacttgtgcaaggagtgattattaatgagccaaaaaattaaacgcggtgatatcattgatgtaaaaattactggtattcaaccgtatggagcttttgcaagcttacctgataattcaaccggtttaattcatatttcagaaatatcagataaattcgttaaaagcattgatagttttgtaaaagttggtgagtttattaaagttaaagtgattgattttgatgaagaaactaaccatgcaagattgagtttaaaagccattgatagtcgttatcgtaggcgtaataaacgagtttattataaaaaccctagacgattgatcgttgaaacgcctaatggatttgcaccattagcattagccatggaagactggcttaaacaaggaatcacggaggaaagttaaaatgattacattagatttatctaaagccaaattaaatgaagatatcgaatcatataaagatacggtaaaagatatccatgatatgattcataacaaaactggagctggtaatgattttcttggttgggttgaattaccagaaaattatgataaagctgaagttgagctgattaaagaaactgctgctaaattaagagaaaaaacagatgttttgttagtatgtggaattggaggatcttatttaggggcacgtgctgcaattgaagcaattaatggtttatatccaacaaatgatgtagaaataatttatgtgggtaacactttttcatcaaattacatcaaacaagtagcagactatcttgagggaaaagaatttgctatcaatgtaatttctaaatcaggaactactacagaaacatcaattgcatttagaatttttaaagaaatgtgtgaagctagatatggtaaagaaggagctaaagaaagaatcgttgctactactgataaagctcgtggggcattaaaaactttagcaactgaagagggatatactacttttgtaattcctgatgatgttggcggacgttattctgttttaacaccagtagggttattccctatcgctatggctggtattgatattgatgctatgttaaatggggctaaagatgccatggttaagtataataatgctgatttagaccaaaatgatgcttataaatatggtgttgctcgtcaaattttacacaaagctggatatcctgcagaaatgttcgtaacttatgagttacaattggcaatggttgctgaatggtggaaacaattatatggtgaatcagaaggaaaagaaggaaaaggtattttacctactagtgctactttctctactgatttgcattcattaggacaatttattcaagaaggttcaaaagtattatatgaaacaatcatgcaagttaaagaacctgctggtgatatgacaattcctagtgataaagatgatttagatggtttaaattatttagctggtaaatcagttgattatgtaaataaaaaagcttgtgaaggaactatcgatgctcatgttaatactggtaatgttcctaatatcttaattactttagataaaatggatgcttatggatttggttacatggtttatttctttgaaaaatcatgtgcaatgtctgtatatttattagatgttaatccatttaaccagccaggtgttgaagtatataagaaaaatatgtttaaattacttggtaaacctggatattaatagaaaagacgattctcaaatcgtcttttttaattttatgcccgaattgcaagcagagagtggaaataagataaaaaagttctaatttttatagaaaatcgtatttttagttataccaattttagccagttctttgacaaatagctgttctgcaggaagataaccaagtatcttccttttcttttgattgattttttgattaatatctaatgttttttctttatctattgtattaatatcagttcctttctttataaaatatcttataagtccattgcagttttcatttgatgccctatcacatgaatgatatggtctcccaaaataaatctttgtacgctgttcttttaatcctggtttcttttccatatccttccatctggcaaattcatttccattatcgaatgtaatggatctgaatattttcttaaaatcgtcaccataaaatttatgaagcttattgatctgcatataaacttttttagaagattttgatgtaataggaatcatataataaaatcttgtttttctttcaatcagggtcaaataggcaccattttgtccatctcttggaccagtgacaagatcaccttcccagtgaccaaattcctctcttgtatcaacgctttcaggtctttccatgatagaagttcccttctgtcttttagggatataagttttccagttctttttcgtctttcttcttagcattctaggcagatcaattggttttatcgaaacttttccttcgtgtatgtaattatagaaagtcttagtagaaacagttaccatatttttaattttatctttttcatgaaggcgaagataattgatagtctcatcaacagaggaaagtctatttgatttcatttcattttcaacgagagtgataaaatcatgagccttatgaagtttagaattgttaggggtcttatggatcttagatcttttttcaaaggcagccaaagcagaaagttcagtacgttcattaagataggtatctctaacagtgatagtggcatccttaatgatagaatagacattagagacagaagtaccaacagaaacagccaaataatgaatgaattgagttttaccgatattacgcttatgaccagaatgcagagcgttaaaacgaataagttcattaacaataaattcataatgaaaaaactgaaggtgtttatttttagatttttgtgatatagtataagtgttcatagagagtctcctttattaggttttggtcgactaaaataatacgacttctatgaacatttttcatgtaaaaaattaaaaattgagactagagggagttggcggcgaaatgtaatgattggctagccaatcattacattaccttaattccagtttcattttacaatacacatttttaattttatgtaaatttcttattgactaatttaaaagtaagtgataatatagtaaagcactaagcgacggaggtttagctcagttgggagagcatctgccttacaagcagagggtcagcggttcgagcccgttaacctccaccataaaaataaataagccggcttagctcaactggtagagcaactgacttgtaatcagtaggttgagggttcaagtcctttagccggcaccatgatggaggagtagcgaagtggctaaacgcggctgactgtaactcagttcctttggttcggtggttcgaatccgccctcctccaccatctaattggggtatagccaagcggtaaggcaacagactttgactctgtcatctccctggttcgaatccaggtaccccagccaagatgacccgctagctcagccggtagagcatctgacttttaatcagagggtcaggcgttcgaatcgcctgcgggtcaccatttttaaaaaaagttattgcaaatatcttaaacatatgatattatattaatgcgttgaaattgcgggtgtagttcaatggtagaacttcagccttccaagctgactacgtgggttcgattcccatcacccgctccataaataaaagatagtcgatgtaatcggcttttttatttacatttaaactcacattaaaatgctaagttctatttataaagaacttagcattttatattttgtaacaaataaaattatagaagagcaattattttaggaataaatatcattaagccaattattgctgcaccgattgctagaacaagaactccgcctgccgctgcatctttagcaatcttagctttaggatgaaattcaggcattaccatgtcaactactgcttctattgccgtattaaataattcaccggcaataactagtgaaaataagataatacatattttccattgcgcagcactcagctttaaaacaactcccgcaacaattactaaaagcattacaaacaaatgaatcttcatatttgtttctgatctaatcgtcattattattccttcaaatgcatatttaaagctatttattcttttttttaactcctgcatcaaactattacccccttctatcatataaaaattttactaattattctaattaaaatcaatcttatttatctttttaataacagtaacactttttcaattatttactgatcctgctaaaaattaaaactgtctgtaaagccaataaaataaggctatccagacagttaagagtatttaaagccatgctattttaggaatatatgtgtatttgctcaataattgataagcttggttaagcatttctttttcattatcaatattttgataaatcttaagcagttttgctttgattaaattatcattacaatcatcatttattgccagctgcataaattcacctggaaataacaaacgggcgtataagtatactaattcatcatttgttagattggcactatttatatattcttctaactcattgatcataattaaattatttttatatccggtagttaagtctttgattcttgaggcaataacaaaattacttggacaacacagtgtttcatagttatcttctaaataaaagtgttctataccagctggcagtttaatagattttatctgatttaaaatactgatagcacattcccctaatccttgataataatatgataatactacaaaatgttcaaagtgactgattctagaagcataattacctattttgcattttgcttcatctaaaattttacaccagctttcttttatttttatcacttcaatcgtggaaggaattggaatcattgatcgacgaataaacatatctaaagtatatggttcaatttgataaatatataaaatatggtccatagttataggacgatcaaaacaattatttacaactgtaaaaccagctaaatttaaactatgaatataatacgaatagttatttgtaaaattatttattctacaaaaataataattattattttgatacgtaaaatagtcactttcttgatctatataaatttgataaaaacgttgtaatatttctaattttgataccaattaggcacctccccttcaataatttcaattactaatggataatcataagctttattaaattcttcattataaaatggcaacagaaccatcattttaattttaatcgttaaggataatgaaaccattacatgattaacaccataactctttatttctttgtttacagtgcaagtaatcgcagaaatggttttatatctaatttttatttttggtcctatttcagctaaaaaaggattgtctgtcatcatccctaaaggtacactagcaatgacaccaccattattactgatttcttccaatttacgttgataaaatgtgtcatctgtttttttatatactccctcctctaacgaaacaaataattcatctaaattatttactatctttgctccgatactcgaggcataattagtatcaaaattaatcgttgaaatctcgttaccactacgatttacttttattaattcctgatgatctaattcaactggaaaaggtgtattattgattaccatttgacaaaaacgatctatttctttggtggcgattttctttaacattggcgttatacttacactcaaaaaatgcaatataacgcccaaaatcactataataataatgaacaagtatcgttttttcatcaaatcaccaatatagtatattaagtaacctcatcaaatatgctttgtggcaaccaccttatataactgaatgataatactaggcattgttgcaaaaacaaaaatcattgctaaatgacgtaaatttagttcactaatagaaaagatagtatgaaaatttggagaaactaaaatccagcccaataaaactgttccaataataaaagctccaatactataataatttagtggcatcttatataatggtaagttactacggcaattaaaaccatgtaatagccgcgccaaacataatgtcccaaaagccattgatgatgctaatagttcatcagtttttaagcctacaaagtaagataacattgtaaaaatacaaataatcactccttcaaaactaatttgtaataacgtttctttatttaatagagaatcattcatgccacgaggtttttgttttaaaatttcattactgccctgttccatcccaatcgcaatagctggaagagagtctgtaattaaattgataaataaaaggtgcactggtaaaaatggtgttggtaaaatcataaacgaagtaattaatacacagattattgctgctaaattccctgataataaataaattatcgcattttttatatttgtataaacattacgtcccgtaattattgcttgtacgatcgtagcaaaattatcatcagttaaaatcatactagcagcatctttagaaacctcactaccagaaattcccattgctacacctatatcactttgttttaaagctggcgcatcattgactccatcaccggtcatcgcaacgatctgtccttgattttgccaagcctttacgattcttattttatgctctggggcaactctagcataaacactcgcccttggtaaaacatttgctaattctcgatctgtcattctttctaactgaaccccttcaagacaaatatctccatcttgataaataccgatatttttagcaatactgcaggccgtaacaacatgatcccctgttatcataattggtttaattccagcaataagacaattttttactgcctctttactttctttacgtggcggatcgatcaatgaaactaatcctacaaatattagatcagcttcatccctaacatctagcgtatttttataaaattccttatacgctaccgctatgacccgtaatccttttttagcaaagtcttcattttgttttaaaattcttcttcgttcgatttcagataaaatttctttatacccatcaactaagattctattacaacgttgtaataaaacatctggagcacctttagtatatagatgatttttggagctaacactcattaatttacgagttgaatcaaaaggtaattctaattgtcttttggcaattaacttaaagggatgtttaattgtatagtcgtgataaagatttaataatgctaattcagtaggatcgcctacctgctggttattgttgattgtagcattattacataaagcaaatgcttttaacataagacaatgattatattgatgatgatccatatcatttacagaaactatttttttatttgtatatatatctattgctgtcattttgttttgggtcagtgttccggttttatctgagcatattactgaaacacaacctaaactctcaactgcatttaaatttttaataatagcattttcttttgccattttttgagttgaaattgataaaacgatcgttactattgatcctaatgcctcgggaattgccgcaacagctaaagctacagcaatcattaatgaatctaaaatattttctttagcaataaagacactcattattaacacaataatacaaatagaaataatagcaattgataacttaacagaaaactcatccaatgttctttgtaaaggcgtctttctttgttttgtctcattaagcattccagctatttttcccaactcacttttcatacctactgctgtaacaatatactgtcctgtcccattcgttactaaactacctgaaaagaccatattattcatatccccaatagtacatttcttttcaattggtaacagctgtttttcaacactatttgattcgcctgttaaagcactttcattaacctggagattaaccgcttcttttaatcttccatctccggctataatatcaccagcttcaatatttacaatatctcccactactaactcatttgaattgattatctggactttgccatcacgaataactttaactttaggtatcgatagtttctttaaactatcgatagatttttgtgctttaactgtttgaaaagttcctaatgctgcatttagactaattactatcaaaattactaaagtactttcaaattcaccactgattgctgaaataattcccgcaacaattaaaataataactaaaagatctttaaattgatcaataaatattgcaatcgcactttcttgtttttcactaactatttcatttttaccaaataactgtttatatttataaatttgttttttatttaacccctgattaaatacccctaattcattttgaacctctttaaaagatttttgataagcctccattttatcctcctatctatactcttaataaactatacaaaaatattaataagaaaattgtttaaatataatatctaaactaaaaaaccaagtctaatcaagacttggttacagtgattattgaaaaattattgagattgccataaagcctttaaaacgtgttcaccatttactgttacaactgtatcaccagtaataacttcaccactatagatccagcctaaaaactgatatccttctttagttggctgaggcaatttaccataagtatcattataaacaacttctttagattgtataagttcattaccaccatcataatcaaatataacatttattttattaggtttccaagaagcatataaagtcatactttgttcaactttttgtttgtcaggattccattgatgctttaagtcctgatcaagataccagccatcaaaagtataacctgctttttgtggtttttcaatttcaattgaatcaccaattttacattcaatcggctttatttttccaccaccattagtttctaaagtaactgtaaaatgaccattgattcctaaaaaaatgacaacaccaattaaaataaccattaaaataataattatataatttaacattttaacaggaacattgactccacgatacattcctccaccagagccccaggttttctgttttttttcaatctcttgttcttcattcatattatcaccaattttattttcttactaaatattttcgcatatcaattgcacaagcaactaaaatgatcaatcctttaataatatactgcatattcgcatcaatacttaaaaaagttaatccaacaaagataattcgtaataaaacaacaccaataattacaccacggatctttcctataccaccaacaaatgatactccaccgataacacaggcagcaattgcatccagttcatagtttaaccccgttgcagcactatttgaaccaattcgcgctgattcaacaaaacctgtcaaaccatacatgattcccgctaacacaaataccatgataatcgttcttgaaacatttactccagatacattagcagcatctggattagacccaactgcaaacatattcttaccaaactttgttttattccaaataaaccacataatgattgtaattacgattgaataccaaacaaaatttggaattcctttattaccaatactgattgctgctccggcaataaaacctgtataactagcatctaatcctgagattgattgaccattattagtaccaatcatcaaatacattaataaaataccatatacaatcaattgagtagctaaagttacaataaatggatgtaaactgaacttagaaacacagaaaccatttacaaaaccaacgactgctccaatagcaattgctagtaataaaaccacaaaaataggcattgttgcaagatcaggaaacattttattagcatatcccgatgcttgtaaaagtgaagctgaaatacaagccactaaacctacgatacgtccagcagataagtcagttccggtcaaaataatacatcctgcgattcctaaagcaataggtagatttgcagctgaaagtgaaataatattaataattgatgaactagataaaaatttaggactaatgatttgaattgcaattatagcaatgatcataaagatatataaagaattattgataagtaattcttttaaatacgtttttttatctttgctgtttaattgcttaaaatcattatattgtctagttatcccactaaatatttttgtcatataataattctcctttatacatattttgtcgcaagtgtcataatttcttcttgagttgctgtcttagcatctacttcacctgcaagtcttcccccagacattaccaaaattcgatcacaaactccaagtaactctggcatttctgaagataccataattactgatcttcctttacttgctagatcaataatcaactgataaatttcgtatttagccccaacatcaattcctcttgttggctcatctaataataatacctcaggatttgtaagtaaccagcgtcctaaaattactttttgctgattacctcctgataaagatcttatttgtgtactttgagaaggggttttgattctcattgctccaatcgaccattgagtatcaagtttcatttgcttatcactcaaatataaatgattttttacataactgtctaaattggatatagttgtattttctctaatatctaaaattccaaaaataccagttgctcttctttcttcagtcaacaaagcaaaaccattttttattgattcacgagctgatttatttttgataactttaccatcaattttaatcgttccatcttttttcgttgctattccaaaaagagtttctacaacttctgtacgtcctgaaccatctaaccctgcaattcccacgatttcaccacgctttacatcaaacgtaatatctttaatatgattatacatacctgttaatttatctacttctaaaacaacttttccgatttcatttgttttaggtggaaaacgattagttaattctcttcctaccatcagcttaatgatcttatccatcgtcagctcactagctggtttagtagcgatccattgtccatcacgcatgatcgtaacttcatcacttatttttaaaatttcttccattttatgagaaatatatataattccacagcctcgatcacgcaacatattaataattctaaacaaatgttccacttcctgttcatttaatgaggaagtaggttcatccaaaacaataattttagaattatatgatactgctttagcaatctctaccatttggcgattagaaactgacatcgtactcataattctttttggatcgacatcaatatccaaatctttaaaaattgccttagtatttttatacataatactttcagatgtcataattttaaatttagtaggatatcttcctaaccaaatattatccatgacatttctttttaaagcctgatttaattcctggtgcaccattgctacaccatgctctaaagcatctttagagtttttaaaattaacttctgttccttctaaaaaaatttgaccactatctttaacatacattccaaataaacatttcatcaaagtagatttacccgctccattttcgcccatcagtgcatgaacagtaccacgttttaccgtcaatgaaacattatctaatgcttttacacctggaaattctttactaatgtttttcatttccaacaaaacatcactcataatttccctcctttatttattcataaaattaaagaggtgtttggataacaaaccaaacaccccacttattttttattcccctaaatatttaccataagcgatacgaatcttagcagcttttttatccacgttataatcttttgttccatccattaaatctttttcagctaaagcattttgcgttaataatgcaattgcttttgccataccatcagcatcttgcttaatagttcctgccattttttgctttttaattaaatctttcgcagcatctgtagcatccactccaaatactggaattgatttaccaacattaccttctttatctacacctgtattatatccgaccgaatttaaagctgtaatagccccttcagccataccatcattgttgcaaataaccaactcaatcatattattatgactgtcactataagcagctaatgctgtagtcatatattcgttagctgcagttgatgaccattgtccatttttatcaactaaatatttatcattatttgatgcatcatagaaatttaattctggtttaccagctgcaactaatttcttatttgcatcttcaacagcatattgggtacgataaatcgcttcgttattcccttcttctcctttaaataagatataagaaataacaccatctttatttaaatcataagcatcataatttgctaataaatattcaccaatcatttctccttgtagatgtcccgcctcagcagcatctgttcctacaaatgcacatttatcatagccgtttacgattgtatctgaaacttcacgattaaagaaaactacaggaatattttcctttttagccatatctacaattccttgtgctgcatcatcagaaccagtatttacgatattaacaactaatactttagcccctttagtaattgctgtctgcacttgttctgtttgtgttgtctgatttccatttgcatcatagtcttggtaactaacaccagcatctgtcaattgttttcctaaagcagttcttacactagagatatatgtgtcgctgtaattataatagaatacatgaacatctccatctccttcaccgccacaaccagttagtactgaagccatacatactaacatggtacatgataataaaaacgataatatttttttcatttttagtcctcctctataatttcgttttcaattatttatattttatttgctggcactaaatattgtaatataatatcttatcttttatgggtaaaaaattattccaataaaaaaatcttcctttatcggaagatcaatcgaatggaaaaacaattttttgattatcctcttgaaacatattatctttagtaatcactactgttttagtataaatgttttctttactactttgtctccttgataaatgataagcttcctcaactcctaaataaccaattgcaaaaggattctgtacaattaatgcatctactatgccatcctctaacatttgtatagaaacaggattattatcaaaaccaattacagaaactttatctttatattccagttgttcaattgcataaccaactccaagtgttgtccattcattaaaagtaacaagaacattaatatctggatactgtaataaaatatcttttgttgcttgcgttgtataatcaaccgctgattgaacatttataatttttacagataaaattctttcatcattttccaatattttacgcaaaccactttctctttcttgtccatttgcagtattaacatcaaaatttacaattcccagatgaatcttatccccctgcaacttaaggactgtttctccggccatcttacctgcttcataattatctgtacttattcgagtacgaactttttttgaatctacatcactatcgataacaactacttgaattcctgcctcaaccgcggcttcaacgctctctactaatttacgataatctatagctgataagacaatcgcgtcaacatcatccttgatagctttttccatcatttttatttgtgttgcataatcctcttcattttcaggaccattaaatgtaagatctaaattatattctttactagctgcattagctcctgataaaactgatttaaaaaattgtgatgtggttgatttaacaataactgccacctttactttgcgacttacactattacatccaattaatgcaaacatcaatataattacaatagttatcttttttattttatcacacactatatctatcctccatcacagcaggaattttgatcgtaattgttgttcctacatctaattcgctttcaacaacgattccataattgttaccaaaatatatttttattcgatcattaacatttttaacgccaattcctttactatcagttcgttcttttttcaaaatattttgaacctgctcctcactcattccaacaccattatctttaattttcataataatatcattaccgactttatgcactgaaatagaaatttcgccttcatcaaccattctagaaattccatgatataaagcattttcgataattggttgaattgttattttattacataaataaggtaaaacttcttcatcaatatcaaagttataaataaattgatctttataacgatagctttgaataactaaatagtttttagcatgctgaatttctttttcaattggaatcagttcgtaaccttttgagatactaattctaaacagctgtgctaatgcgccaaccatcgtaatggcatcttcagttttttcttcttcacacatccattgaatagaatctagagtattgtataaaaaatgaggattgatctgtgcctgtaaagcttttaattctgtttttcgtaatgcaacttcttcatttttaactttttccatcagttcttggatctgaataaccatatgttcaaaagaattagataatttattaaattcacttgccccttttaccggtgtatatttaaaatcaacagcatttttttcaaatatactcattgcttcaacaagagaacgtactggtttagttaactttttagataaaataaacaaaatgacaattgcaaaaatcattaccagcaaggcaataacaataattgatttaaccgcagtagttgctttagcatctactaattcattaacataactaaccccaacaacacgccaatcaaattctgaaacatctttaactgtataaattacgccattatttattgtatttccttcatgatagtgaataacttcacttatcttttcatcttttatatccaaataaataagctgctgtaaaggatgatatactaaatcatcatttttattaacaatgaaacagtatccatgatctccaattccaacatcatcaatataacgagcaattgaaacaaaacgaatatccattgctacatatacaagtttatcataactgcttgaccattgtttttgacatactgttacaacccagggataatttccctcaaaaagattctgaacatgcggtgatgtaatcgcataatcgcgattattactaaataacgttttatcaaatgataagttattatttacattagtttttaaagcagcattgctttgataatccaaaatattaccttccatatcataaacaataatagaaacaatatcttcattaatatttaccatcgtttccatatattctttaatactaacaatatcagtagattcgttaataattttagtcatatcattcattttatttaagatatcatttgaataattttcaattgtattcaagacctgggttaccgattgctctgaattagtttgggctgtagataataaactatcttttaatatttgtctaaatgaaatagttaaaaggaaaacgacgatgataataatactgacaacaaatagtgataaataaatagaaatcgaaaaatccttttttttaaacttcattatttaccaccgtattttgttcacgcattttatttggtgatacaccaaattgttttttaaaacaataactaaaataatgttgatcactataaccgcatttataagcaatttctaatacttttgccgatgaatacaaaacaagatctttagctacttccatccgttttctagtaagcaaagtaataaaagtttcacccatattcttttttaccaaagaacttaaataactaatacttacatgcaatttatcactaactacccctaacgacaattcctcattactatattctttatcgattatttccattaattcatcacaaatcaattcactattcatctttttttgatctttaattaaattttttgataatatacaaaatttaattaaagccattcttttttcattaaaagaatatttattaaatatatttgataactgtgaagttttactaaaaaatagagatgaagatttagcatcacaaacagaatatacaagagcccatatagaagaaataattctaaccatcaataaatcaatatcagcccgactcgcaccttgatcaataaacattacaaaaacactagataaatacaattctatttcactatccgtcccagatttaatcaacttctctgtcttacttgcaattttatctacattttcataacaaatcatcgaagtacgcttaatatcaccaataaaatttattcctcgttttgatccctgaccatattcaacagcacttattgcttcattatacaataaattaacattcaataaagaatcacttatgttgctgaatcccaaataacaatcagcacataaaattcgttcactgctttgaactatttcgttagcgataatatttacatatttatcgatttcccaagcctgtccagaaagtaaagtaatgatttttttaccagaatagaatgttccaaaccgtaaatattttttgataattctttttacccctggtaaatgctgcctatttgtgatatttgtcccttttttatcaaaataacgaatcaccatcattaaatactttgttttttcttctaaactactcctgatttgtaattgaacagcttcctgattaataagattttcatattcttttcgcttatcatcaataataaaatcagtatcaaatatcaacggcattaataatctttctactaaaaactgctgttgattactttcaattgaagccataaaagattgattgatagcatccatcttttctttaatatcaatcagttcttttgtcagttcttttgatgaaattggttttaataaatatttgatgatattatattgaattgcctgctgggcgtaactgaaatcatcataaccacttaaaaaagcaatttgcattgctggtctaatttcccttacttttctagctaaattaattcctgaaataaatggcatttttatatcagtcaataaaagatcaggttctaaacgttctactaactctaaagcttcaactccattttcagcttcaccaataacctcaaaacctattttttgccaatcaattctttttatcattgctcgacgtaatgcaatttcatcatcagcgattactactgtgtacattcgtttcccctccgttactttaaactgaaaccctttacaaattgtatcataaattcttcttagtcggtataaatttaataaattaatttcaaataaaaataactggaaatattctccagctattttattttattttattttctcttcaaaaaagatttaagcattcctacaaatatatcacctgaaataaaatatgcatatccaaatgctaaaacaatatctaaactccaaagaattggatcattagaccaagctagtaatgaaactatggcaataactataacagttaaaatagttaatcgtttattaattcttaagcgataataatttttatttaaatcataaaaacgatatcctgctaaaaacaaattagctactaatgttgaaagtactgcggcttgtactccaattttattaattaaaagcaaattaattataatattgatcactgccgccatcgttgtcgtaatcgacatatttttagcacatttcacagctacatagatacttccaaaaaattgtgaaaaacaataaaaataagtagcaataattaaagttggcgtatagttaaatgcttcatataaagattcatttcgacataagatttcaaaaataattggtgaaactgcaagcaataaaacagttcccgctgaaacaatacaaaatagcatcttaaacattcgattataatatcgaccactatcaggatcattgacacttcttgttgccgaatcagtccaggccagattaaaagctggatataagatattgacgattgaaggaattttatttgccagcgcatagataccatttgcccctgctcctaaaaatattgaaatgatccagcgatctgataactgattaatataccatgatactgtattaggaataaatggtaacgcatactgtagcatttttgaagcatattcaattctaagatgtcttagactaaaatagctaaagatgttacaaacaaaaagaacatacataaaacctgccacatcggctagcgttaaagcaatcaagacaccaatatatccggtttttaaccataataagcaaatagatacgataataaaattcatgattacaactaatgctgccaaaatagaatattccttatatttagaaaatgctcgcaaaacaaatcgtgacgttgtagcaagaatttcgatccaaatataaccaataactaaaaacttataacttccgttaaataaatcgatgggaacaaaaaaacaaataatcccagcaatcagcatcagcataaaaatcattacatagccattagtaattactcttttttgttctttaacacttttagcatcaactaaaaacctaaataatgcctgctctaactgcaaagtacataaaggaacaataaacgataaaatcgtcgtcgttaccaaatccagctgtccatattgagcatctgtcgttgttccagtaatgatcggtgtcgttaataaatttattattcttggcaaaaaggttccaattgccataatcaatgtatttttaactagtgttttctctcttgacataatttcaccctactttacatccattattatagcaaacctaaatctatttttcatcaattattgtctttattggcaaatcaaatctttctactggcagcttttctacttgttgaaaggtaaatgctaaaccaattaccttgccttcataatcttttaaatagcgatcataataacccccaccatatcctaagcgattatggtctttatcataagatacgattggaacaatcaataaatcgatatcttttttattaactaatttatcattatcaggttctaaaataccataattacctttttttaattcttttaatgaattgatcgtataaaaattcatttcatgattttcggttttaggtacacagattttctttactgccagcatttctttgatcaaagaaatagtattaacttcatttctaaaagacacataaataccaatagttttagcgttgataaaatcagaattcttttttaacttagaaataataagattagatttagtaagatattcatcactacctaaatctaatcttgcttgaatcattttttttcgtaattttgctttatccaattccttgatctccaaaatccaattttatcaactgatttaattcaacagcatattccattggtaattctcgcgcaaatggttcaataaagcccattacgatcatttccattgcttcttttttcgttagacctcttgacatcaaataaaacaactgttcttcagaaacttttgatactgtcgcttcatgttcaataattgattcattatttaacatccagttaactggtaccgtatcacttgtagaaatatcatcaagaatcaaagtatcacattcaactttgcttttagcgttataagcttttttaccatgctggaccattccgcgataattgacttttccaccacgacgcgataccgatttagagacaatactgcttgaagtatttggtgctagatgaatcatctttgaaccagaatccatgatttgattttcacccgctacagcaatcgtaatacatgatcctttagccccttcttccattaaaacacaagtaggatatttcattgttacagcactaccgatatttccatcgacccattccatcgatccatttttaaacactttagctctttgcgtaacaagattcaaaatattgtttgaccagttttgaatcgttgtataacgacatttagctccttctttaacaatgatttcaactactccagcatgtaaagagtcttttgaataacttggtgctgtacatccttcaacataatgaatatcggcacccttatcaacaatgatcaaagttctttcaaattgagccatctgctcagaattaattctaaaatacgattgtaatggtttttctaatttgactcctggaggtacataaataaatgatccaccagaccaaacagcaccatttaatgctgaaaatttattgtcattataaggaataaccgtatcgaaatattctttaaataattccggatattctcttaaaccactatcaatatctaagaaaataacacctttttcattaacctcttttaacatattatgataaacaacttctgattcatactgagtacttaccccagataaatacttttgttctgcttcgggaatacccaatttattaaaagtttctttgatcgtttctggtacttcttcccacttatttgtttgtttatcactaggacgaatataatatgtatattcatcaaaatcaacacgacttaggtcaacgccccacgtcggcattggtttatccatgaaacagcgatatgattttaagcgatattccagcatccattctggctcattcttgattttagatatttctgtaacaatttcttcattgattcctttaggtgttttgaatactgaaacatcaccatcattgaaaccatatgcgtactcttgatctggaatttcattttttatatcagccatatgtttcctcctattcttgatcgagaatttgcttgattcctgtccatcctaaagttgcacatttgattcgattagcctgtttatgagtattcataaatacgattgcttcttcaagaatctcaggatcataatctttttcatatatcatattataataattttcaataatttctttagcttcatcgactgttttaccaatcaataattctgacatgatcgaagtactagcagtacaaatagcacaagcctcaccatcaaagcgaatgtctttgataactccatcttcaaccaatgcctgaacatcaatatcatctatacatgtttctgaatccatgtttacagacttataattatcatcatcaactaaaccatgattacgtggtgattcataatgatccataattatttgtcgcatcatcatactatccaaagaaggcatctaaaaagtcatctcctttcttacatacctcgataaatttatcaatttcttcaaaagtattataaaaataaaatgaagccctaagtgtctggctaacatctaaaaactcatcaagaatcttagcacaatgttgtccggctctaatagcaattccatatgtattaaataatgaagcgccatcctgactaaaaacccctttaatattaaaagcgattgcaccatgaccattaggattatatacttcaatattatctaattctaataattttttaacggcatattttctcaattccagctcatatttatgaatatcatccattccaatactcatcaaatattcgattgctgctcctagtccaataacaccctcaatattcggtgtcccagattcgaattttgctggaggtgtctttaatttgacatttccacaacttttatatcgggcgttgctgcctccgccccagcgagtcggtttcgtttcttctagtaaattatatttaccataaaggatcccaactcctgtaggtccacacattttatgaccagaaaagaccaaaaaatctagatccagatctttaacatctactttttgatgaggaacgctttgggcaccatcgacacaaacgatgattcctctttcatgagcaatcttacagatttctttaattggactatcatagcccaaaacattagtaacttgagcaattgaaatgatcttggtcttatcagtaattgctttcattacattttcaactgttaaacgaccattatcatctaaatcaatatatttaattacactgcccacactatcacaaacttcaaaccatggtaaagtatttgaagcatgttcagctaccgtcagtaatatttcatcaccttcatttaaatgtgtcattccataaccaaaagcaatcatatttaaaccatcagtcgttccgtatgtataaacaacttcatgatgatcacaattaataaatttagcaacgatttttcgcgttctttcatattgctcatcaacatcatgcgataaatcataatcaccacgatgagcattgccagaataattcgttaaataatcgcatacagcatcaattacacattgaggttttaaagtcgtagctccattatcaaaataaattaacggttttccatgcatcatagtgccatttagcatcggaaaatcttgacgaatttttgtaatatcaaacattaaattcccaccttttctcttagtgtttcattaaataattcttttaattcatcattatcaataaattctagtactggaataaaatacccatacgtaactagatgcatggcatcttccttacttaaacctcgtgactgtagataatataaatgttcttcatcgattttaccaacactagctccatgactagctttgacatcatattcatcgatatataaatatggattagcttttgcgttgcagccttcatcaaaaacaatgatcttatttgtttgatgactgtttgactgacgatttcctttttttatcgtcccaattccatcaatgatcaaatttgctttattttttacaacaccataattatccatgatacctgtagtatacggcgcttcatgaactaatgataatgttaaatgtttcttctcttcacctctagcaagtgctgctaaacgcaccgttgcattggcattttcttcaattaaagcgtaattaatatttgtatcgatactgttatttgacagttcaacatatgcacacttaacactactatcacgttttatttggacattttcaacaatatttgttttaacttctatattactttggttatcaacatatcttaatatattactattttctaatatttcaatatttttaatgaatttagcatccactttaaaatcatacgtttctaccaattccaatgatcctttgatcgatagatcgattttgtaatttcctgtttgatcaatcaggtaaataatttgtaatgatccggcatcatcaacaatgattttattatcgattattttgattttatcattacttttatgacttacaattgtaccattttgaactactaaataatttctaatatcttgtaattgattcattatttaattttcattctttctttattggcacagctttcaagtaaaatcggtttcttttcattagttactatttcaacccctaattcttttacccagtcataaccttcttgatcaattttttccactacttcttttccaccacttaaaataatttttccatcgactaatacatgaacatgacttggtgataccaattcaaacaaacgttcataatgggaaaccattacacaaccaaaatcatctgatttcatttcattgattgcattagcaacgatttttaaagcatctacatctaaaccagaatcaatttcatctaataatgcaatcttaggctgtaacaatttcatttgtaaaatttcattacgtttcttttcaccacctgaaaaaccttcatttaaataacgatgagccaaattttcatccatattcaaatcagcgatgtttttttctaatattcgtacaaatttaaataaagatactggtttttcttgatgggcattcactgctgctcttaaaaaatctgaagtcgtaacaccaggaatttcttgaggatactgcattcctaaaaatatcccagccttgcttctttcatcaacgctcatttttaaaacgtcgtttccatctaaataaatacttccctttgtaactacgtatttaggatgtcccatgataactgataataatgttgatttaccattaccattaggtcccataagggcatggatctcaccagtatttattgttaaatcaatcccttttagaatctctttttcaccaatactcacatgcaaatcttctatttttaaagttgacatatctaagcccctttctatttctaactaattctactaaataagttactaaaaaacaaataaaatgataattattaataaatttttttcttttctaaaatagaaacccatttcaatttatattattaccagattgtggtatatttatatgtaacggaggtgtaaaaatggaacttttaaataaatttttacgtattatttcctcaaaaaaaatcacgcatacgttattaaatttaatgatcgtattagcaatcattcttttgattatttccaccagtgatttatggagtggtgttattaatgtcgtctggttagtttcacgaccgtttatcattggctttacgattgcttttgttttaaatcctttgatcaattttgttgataaatatgtaaaaagacgaaatatctctgtcatattaatatatttagcgtctttagcgattttaattttaattatttcacttgcagtgccaatgatttatgatagtatttctgaaatgtttccagcatttaatgcgggattaaaagaaatcggtgtttttgttcaagataattttaattatgatatttcatctttgactagttatattcaaaatattgttagtgaattttttaatgattctaccgttttagatacaacgatagatgttttaaatcaagtattgataaatgtaactaatatcttgatttacataattttagctatttatatgtctagtacatttaatcatattcgtcaaacaataaaaaaaattactgcgagaatcgatcatcagctaccgggatatttaaaagaaattgatttatcactagttcaatatgttaaagcattttttattggtgcaattgcccaagctattacagctatgttgatgtatttattgattgggcatcctaactggttgattttaggatttgtttctggggtaagttccatcattccttatgttggaccagttacagctaactgtttgggcttaattacttctttaggaatggggacgactacgatttttgttttatgcattttgatctttattcaatcgatcgtcatgtcttacattatcacacctaaaatatattcctcacgaattgatttaagtattatgtgggttctttttggaattttatctggttcatctttatttggcatgttaggaatggttattgcgatgcctttattagtaagtgtaaaagtgacttatcaggtctacaaagaacaccaccaggataaattattaatttgatacacttagtgtatctttttgtttgaatttcaaaataatatgtattatattattttcaggtgatgaatatggaaaaagttaataatgaattatcaaaaaaaataaaacgtatttttccaccctattttaaagaagaactatttaattgtataactcatggcattatggcctttatcatgcttgtcttgattccagtttgtgctgtatatgcttatactaaaggtggaatattacaatcatttggtgttagtgtttttaccatttgtattttcttaatgtttttagtatcaactctttatcatgcgatggatcatgacagttcccataaacaagtatttagaattttagatcatatttttatttattttgcaatagcaggaagttatactccagttgctttgtgtttgattaaaggataccagggaattatcattttaattatccagtgggtcatggtattagttggcattttatataaatctatctcaataaaaagccttcctaaactttctttaacgatttatttggtgatgggatggactgcaatattattcattccatcaatcattaataattctagtgccatttttctatggctgatcgttgcaggagggattatgtattcaattggagctttcttttatgcgaataaaaagattccttataaccatgttatttggcatatttttatttcaatagcttcgatcttacattttattgctatcgttttctatatttaagggatgtcaaaactgacatcccttttcattaacacatattacagataataactaataatatgaataaaactaatactaaagtaaaagagttatcttggcaagccattgcaatcgcctccttttataaacaatagataccgacaataactaaaataatgaataaaacatacatatgaacatttttgcatttacagttactcatctatttccctcctaccacctacatattataaattatgttaaaataacaattgctagtgtgtttttgcctattttattgaaattaagtaaagaaaatagtataatcatatcgttatggaaaagataaggaggaaaaatatgaaattaggaaaatatgctgctgctttagtagtaactagtttcttattaactggatgcggtaattccaaaacagttaaagaggatgggaaatatgtagttgcctctttaagcaaagataaaaaagataaaaatatctttgctgatgatatctttgaggatatcactaatacaactagtggtaaaagtgctttttttgaggctgttttacaacaattgatggatgacaaattccctattgatgatgacatggaaacagatgctaaaagaacagtagatcaaattcaagcatactacgaaagccaatatggggatagtgctgaggaacaattaaatactattctatcttctagtggttatgcatcattagatgcttatcgtgaagcaatggttaaagcttatcaaaaatctaacttcttactagattatgtagaaaataattttgatgaagtttttgatgactactacacacaatcaagtcctcgtgaagcaagcattatcaaggttgctatgactgatgtagataatccaactgaagctgaaagcacaaaattgaacgaagtagctgctttgatttcttcaagcaaatcatttggtgatattgcaaaagattattctgatgatactgctactaaaatgaataaaggtagtttaggtgttattgataaaactagcagcattagcagcacttatggcagtgatgtagaaactaagattttagcattaaatgaaggagaaacaagtgaagctatcaaaggtagtgatggttattattttgtaactgtaactaacacagacaaagatacaataaaaaaatcactaaaaaaggatctatcaatagatagtccattgatttcttatgatttgtatctaccatatattgcatatcaatcatatgatgtaaaatatagcgatgacgatgttgaaaaacttgtaaacagtattatcgaagaagcgttaaaagaacgtgaaactagtagaggaggaactgagtaatgaagaaaaaaatatttccattaatggttgctggaactttattagtaggatgtggttcttctagtgctgtaaattattcaagtgaagtaagtgatggtgacaaagcagtaattactattgatgataccaaaattaataaaaacgaaatatatcattatttattagaacaatatggaagttctgaagttttatctttagctcttacttatattgcagatcaagaaatcactgatgaagatgccatcaaagctaaagtcgatgaaaaagttgctagtacaaaagaaaatatatctacttctttagatgaatatgcaaaacaattaggttatgcagatgaacaggcttatattgacggtatcgtaactgttggcgttaaacaagaaatgcttaaagaaaaatatattgatgaaaactataaagctttagttaaagaatataaacctaagtatttaaaaatcattacagttgatactgaatctggggctttaagtttgatcgatcaaatcaatgaaggtgctgattttgatactgttatgaatgaaaacagtggtagtgatgctggaatggtaactactgagtctactagtgttgattctaaaattattgacaaattagataaatttactaaagatggtttatatagtaaagtaattaaaacatctgaatctaaatatgctgttatttatgtctataatagtgatcaaagtgcgattaaagatgaaattaagagtaatttagcttctattagtgaaatgtcaactaagatggaaagttattatttaaaacaatataattttgacatttatgaagaagcaattaaagatgaaattaaagaagctaatgaagattatttaggataagggtttacccttatcttttttatatgttaaaataaatttatggaggacgtatttatggaaaattgtattttttgtaagattgcaacaaaagaaatacctggaaaagttatttatgaagatgatatctgtctggcttttttagatttaagtcaaactactaatggtcataccttggttattcctaaaaaacattataaaaattttttagaggttgatgatgatactttagctcatttatcaaaagtcactaaaaaacttgctaaaaaaatcgttaccaatttgaacgctcaaggagtaaatatccttactaatgcaaatgaagctgctggacaaactgtgatgcattttcatattcatattatacctcgctatgaccaaacagataaaattgaaattaattttacagatcgcagtaatgatattgatcttgacgatattttagctaaaataaaaaaataacttatcttataaaaaagattatttttagttgtgatttataggtggattttccaccttttttaataatataaatatttttccaaatctaaaattattatttcaaatttattttttacactgatctctatctactatcaatagtttcaaaataaaaagatatagccatggttcttactcaataatgagtagttaaaaataagagatttcaaaaatgattatatttaataatcatttgagaaatctcgttttctcatatttaccctaaagtaagaaagaaccatttctatatcttttttaattcatttttggtttataaaaagctctattttctaaggcgaaaactctttttgaaaaatttccaggttctactgtttctagtgccttttccagcatattgattcttgcatccatattatcaattaaataaacgatttctgcttcttttatctgtggcaatactggtgatccaaattcatttttaccatgatgtgatagaatcatatgttgaagtaatgttacttcttcaccttcaatatgcatcttatcagctgtttccttgatcatagcctgtgaaattgaaatatgccctaataatttaccttcgattgtatactcaggaacaactggtccacttaactccactattttccctaaatcatgtaaagtgattccagcaaataataaatccttatttaatgtaggatacaaagtatataaagcatcggcaattttcaacatactataagtatggtgagctaatcctgatacatactcatgatgatttttacttgcagccggataaatagttaatttatcaagatgttcttcaaaaatagctttaaccaattgatttaattttaaattatcaatacgatcaatatatttttttatttctttaattagttcttcaccagtttttggagcgctttttaaatattttacttgttcttgaggatcattagaagcaacatgaattttaatgatcttcatttgacgatcttcgttatacttaattatatcaccttttacttgaacaacagtgcccatgataagtttttctacttgttcattagtagcattccaaagtttagcatcaattgatccacttgtatcttgtaaagtgatactcaaataagttgatcgattggccccatttgtttttccagttacaacacgatttatcaaggcttcaacaacaaccccttcatctcctggttttaaatcctttattttattcatcatttaaagctccttcttcatttaacaattctttaatatgctcataattgtaaccttttcttaataaagtatcaattattttttcttttaattgattcccatgatatttttttatatatttctttttttgctttataaattctttttctaaagtttttcgctctttttgatcatcaaaatcaaaatcataatcagctaaagctctttcaatagtttctgcggtaaatcctttgatataaagtttatcacgaatcttttttaatgttgctttataagaaaaattattattacgattataataagcatcgattatatttgttgcagcattatactcatcatcatgatcattttcttcaagacaacgatcaataatttcactgttgataccataattacgtaaattatatattgctttatttaagccaatacctaagcgtgtgcagcgttttaaataatttagggtataagcctcatcattaattaaattcttttcttgcagcaattctaacgttgcatcaagctgagtatcatcataatcaccattatccattaattttttcttcatttgattataagtataatcttttactgttagtagctttaatgccttattatacgcccttgagacttgttcataatcttttataatatcaaaaatttctttattgatttctttacctggttctaatttataagctctaataactttatcgctaacttcaacaattatctcactttcatcaaataaaaaaacaacttcattactacctttttttattggataaattgacttaacagtataagtataatgttttaaattaattgctctttgatatacatctagcactttttcataaaatacttcactactaaatttcatcgcattcaaataggcttcttttgccatctttgaattatcactatttatcatctttaataaaatactaactaattcatttgtttctttaaagaaatagccatttacaccatcaataatgacattttctaaattttgatcataacgagcaattactggtattccacttgccattgcttctatatatgtcaatccttgagtttctgtaattgaagcagaaacaaaaacatttgaaagatgataataacttggaacttcattactaggttttggaccagtaaagactacatatttacttatatgatcatctttaactaattcttttaattcttcaagctgtggacctccacctacgatcaaacacaacacattatcattttctttaacaacttctttcattgcatctattaacacgtcaatacttttctcttttgcaattcgacctaaaaatgtgataataaattgatcattgattccatactgttgtttaatttgattgatcaatgtttcatttttatttttaggatcaaatttatctaattccaatcccgttggaataacatgcatctccttattaagaccatatttccttaacgcgtcctctgtttttgtagatggaacaatcaattctgtgctcttatcaccataaaatttacttattcgggtaatcgctttttttatcaatccatcaattgctgttgaattaacaggatttacataatgagagtaatctgcccacatagtatgataagtatacacaacaggaatatttaatgattcaccaactattctaccaaatattcctattccaaattctgtttgaacatgaatcacttcaatgttcatcccttttatctcacgcattcctttaaatgaataaatattacaagctcgatatccatataatgcctgaatttctaatcctggaacccttaaaatattatcatcagggtcatccaaataatcgctttcacttggtaattcacttgtaactacaacaacttcatgaccgtgtttaatcaactcatctcgcaaaattttagttgaagtagctactccatttatatctggtatatatgtatctgaaaaaatagctattttcataattccctccatttccgtccgccttcgtcggtcagacacaaacattttattaaaaataattctcatccaatcgtttttgtagtatcctataagagaggtggtatactacagagcacgtggaggagagtaggcaattctactctatatagaatatcctgaataattataagtcgccgtcagtctttcaagcacaaacaagtaggacttagagcctggacacttaagattgtttttatcaactatagtgatattttgcagactgacagtcaatgccacttctccttttttgaaaggagtttttttatgcttaaaatccaccgttttaattgtgctggtcttgatgttcacaagaaccttatcgtcgctaccattggtatcactgacaagaaaactcatgtcactgaatatattcagaaagatttctcttctcttaactttgacctctataatcttaaaaactggcttattgaacacgaatgttttgatgtctgcatggaatccactggtaagtattggttccctgtctttaatgtccttgagactgaagctaaaatgaatattgttcttgtccatcctaaatatgtcaaagctatcaagggcaagaaaacagacaagaaagattccaaatggatttgtgatcttttcaagcatgatcttctcaaatcttcttttatcccgcctaaggatattcgtgaattaagggatctctctcgttatcgttttaagctcatctgtatgagaactagtgaacgtaaccgttatcagaactccatgactgtttccaatattggtttggcttctgttgtttctgatacttttggaaaaacagcccaggccgtcatgaatgaagttctatctactgaagttattgatgaagataaaatcacaaaacttattcatggtaagtgcaaaaacaaagataaaatagttgaatctcttaaaagttcaaaaattgagccagatcaaagatttaaaatggcagaaattcaatcacatatgaatgaacttaatcaacatattgaagctgttgaagtagaaatcatcaaacgtgcttccagatactttgatgattttttacatattacagaaatagatggaatacagcttatgtctgccattcttatcatttctgaaattggcgttgatatgactcaatttgaaacagataagcaactatgctgctgggctggactttctcctgccaataatgaaagtgcaggaaagaagaaatcagttcgtatcaacaaagctggacaatatcttaaaccagtattagtacaatgtgcattggcagctatcaaaaacaaaaacagttattttggtcaaaaatatacaaaaatcaagaaaagaagaggacacaagaaagcaatcatagctattgcaaggatgatgcttgtcagtatttatcatatgattcttactggagaaaagttcaatccttcagactatgaatcatttaagaatccaaagccacaaaaagaaaagaacaattatacagttgagacagcacttgattttctaaaatcacagggatttgatgtatcaacaattcaagatattcctaaataatattctgttttttctaaataaaactgaacttgtttttaagttcgtctttttttgtgtttttactcacgattgggttcaattatttttcacacttttactccgttctatttatctctttattaactgcaaaaattaaaccaccaataatcaatcctaaataatatgtaataaaacgccaaatcagcattgtcgtgggagttccaactgctcccagtaatggtgaaaataacataaaatacaccccttcactacctccactagcccctggaataggcacaaaagctgtaatcatatacacaaacgaacaaatacctataaaattaggtaattgttttattgatacatctatatgaagagctttggccgcaaaaaaagggatactataaataattattagtttaaaaagatttattattgatgattttattaaaatatttttattgcgctgtaaaatattcaattcttctctaaaattttctaatgacttcgaaattttaaatgcagtatctgtataattctttacaatacgaattttacttaaaaattttatgatattattacagataaaattttgaagttttttagatttagcacctaaaaataatcctgcaataacaaaaaaattaattaaaaaaccaattatagctaatgaaaaaaactcactatatatagaactataaatactatatttaaaaatcataatcaccgctgtaaataaaacaagaatactttgatatacaataaaagccattaataaaatacttgccgaattcgtcggctggattccctgacgattaaaaatatatacttgtgcgaattgtccaccactagaaaaaggtgtaattccattaaaaaaagtacccgaaatagcatttacaaatccctgcttataacgataatcttttttgtataaacgaccaaacgtatataaatttaaaccatcaagaacaaaatatactcccatcaagataaaggaaaataaaatccacatcggagaagccgacatcagcgctttcaatgaagcttgtagatcatccttcattgttaaataaataacagctgctcctaatattaaaattaataaaatattaaaaacatatttcttattagatttcttatccataaaatcacctcaaattagagtctaagtgtttcttcatatacctctaataattcttttccgatttttgacagttccctttgtttagctacctcataaccttgatcaaccaatgaaggatactcaccttcaatcattttattaataatatcaacaaaatcatcagtatcattacctttataacaattaacaccatcttctaaccaatctgaaaatactggaatatcacgcaataagacattacacttgcatgccaaagcctctaacacaacaattccttctgtctcttctcgtgatgggaaaaaaaagatattacttcttccgtatgcacctttgattatatcgccactaacatatccaggtaaaatcacattatcaggcaagttatccaaaagatcttttatcttcttagttggatgagataatttgacatctccaaaccacataaatttataactaggtaatcttctagccacttcaataaaagtatcaaaacctttacgttcaaataaccagccaaccgagataattattacatcattatcttcaataccaaacttatttttaaataaatctatttgtttatcagtaggattaaattgtgacaaatctactccattagatatagcactaattggcaatgtgattccataagattctaatattctttttgaatatggtgtaggtgtaattatatgatcacccttagtatataaactaatcaaccattttttatatatacctgatactgaatttgaaaacataaatgaatttctaaaatcttcttctgtactatgcgcatgatacactattttcttattattttcccgtgcttgattaatcattttaatactatcaggccaaacagtattaatatgtaaaatatcataatctagatctgctttatcaactgtatatgaaataccatttaattcaagggcttttttctgatgaataaaagcacgtccaattcccgatttttttatcgtatcttcctgtccaaaatataatttaattttcattttatcaccatggatattatactacaaatcgttaagtattaaaagaaataatatattcactgtataaacaaaaaaaggatacccgaggtatccaaaataaaaaaagaaccggcagcttgctattttcgcaccgcagtactatcttcgccgttatgatgcttaacttctgtgttcggtatgggtacaggtgtgtccatcatgctatcgctaccagatctcttctctttaagcaattcctttcgagaatcactcaaaaccggataatagttccttccatttgctcgtctccaaccttctctttaggttaagtcctcgacctattagtatcagtccgcttaacatgtcgccatgcttacactcctgacctatctaccttatcgtctttaaggggtcttactcacttgcgttttgggaagtctcatcttgaagtgggtttcacacttagatgccttcagcgtttatcccttccatatttagctacccagctgtgccactggcgtgacaactggtgcaccattgatatgtccatcccggtcctctcgtactgaggacagatcttctcaaacttcctacgcccacgacagatagggaccgaactgtctcacgacgttctgaacccagctcgcgtaccgctttaatgggcgaacagcccaacccttggaaccgacttcagctccaggatgcgatgagccgacatcgaggtgccaaacctccccgtcgatgtgaactcttgggggagatcagcctgttatccccagggtagcttttatccgttgagcgacggcctttccattcagcaccgccggatcactaagcccgactttcgtccctgctcgacttgttggtctcgcagtcaaacacccttttgcctttgcactctgcgcttgatttccatccaagctgagggtatctttgggcgcctccgttactctttgggaggcgaccgccccagtcaaactgcccacctgacactgtcccgtcaccagtttatggcatccggttagaactccaatacacgaagagtagtatcccaacagcgactcctcacacactggcgtgcatgtctcttcgtctcctacctatcctgtacatcctgcatcaaagtccaatatcaagctgcagtaaagctccatggggtctttccgtctagtcgcgggtaacctgcatcttcacaggtactaagacttcaccgagtctacagctgagacagcgcccaaatcgttacgcctttcgtgcgggtcagaacttacctgacaaggaatttcgctaccttaggaccgttatagttacggccgccgtttactggggcttcaattcagtgcttcgcttgcgctgacacatcctcttaaccttccagcaccgggcaggcgtcaccccatatacgtcgtctttcgacttagcatagagctgtgtttttggtaaacagtcgcttgggccgtttcactgcggctcatatctctatgagcactccttctccctaagttacggagtcattttgcagagttccttagctatagttctctcgctcaccttaggattctctcctcacccatgtgtgtccattttcggtacgggttactgtatgattagcactagaagcttttcttggaagcttgcttcacgctcttctgtactcgccttagctttccatccgcttcacgccttcgcctttcgacaaccggatttgcctggttgtcagctacctcgcttgcacctgcttttccagctccaggatgcgctagcctgctccgtcactccttcattcataccgtaagtacaggaatctctacctgttgtccatcgactacgcctctcggcctcgccttaggtcccgacttacccagagcggacgaaccttcctctggaaaccttgggttttcggtgcgcgggattctcacccgcgttccgctactcacaccggcattctctcttctatacgctccactgctccttccggtacagcttctccgcctatagaacgctcccctaccacttacatctctgtaaatccatagcttcggtaatatacttagccccggtaaattatcggcgcagagtcattcgactagtgagctgttacgcactctttaaaggatggctgcttctgagccaacctcctagttgtctggacatctccacatccttttccacttagtatatattttgggaccttagctgatggtctgggctgtttcccttttgacagtggaccttatcacccgctgtctgactgccgagcctgtctctgtgacattcggagtttgattatattcagtaccccgggatggggccatcacatattcagtgctctaccttcacttgacctctctctcgacgctagccctaaagctatttcggggagaaccagctatctccgagttcgattggaatttcacccctagccacaactcatccgccaacgtttcaacgggggtcggttcggtcctccatcgggttctaccccaacttcaacctggtcatggctagatcactcggtttcgggtctacgacatgcaactttcgccctcttaagactcgctttcgcttcggctccgcatatcctgcttaacctcgctccatatcgtaactcgccggttcattctacaaaaggcacgctatcaccctttaacgggctctaacttcttgtaagcatatggtttcaggttctctttcactcccctcccggggttcttttcacctttccctcacggtactggttcactatcggtcacagagtagtatttagccttgccagatggtcctggctgattccgacaggattcctcgtgtcccgccgtactcaggtgctgtctcaagcttcctcactatttcgactacggggctctcaccctgtttcgccggacttcccattccgttcgtctataatgtcttcttgctctttctcgacagtccttcaaccccgatccttggatcggtttgggctcctcccctttcgctcgccactacttagggaatcatttctttattttctcttccttcaggtacttagatgtttcagttccctgagtctcacctctctgaagctattttttcacttcaggatacccggtctctactccgggtgggttcccccattcggatatcgacggctcttcgcatgcttactgcttaccgtcgcatttcgctgtttgctgcgtccttcttcgcctctctgtgcctaggcatccgccatacgctctttcttactttacctattggtgttcttgatcactttactatttactttcgtctcttcagtgattcttttcttagttttcgacttctctagaaagacctcaataatcttcttatctcgatctcttcttttctatcgcaaatttcttctattatccagttttcaatgatctcttttaagcaatactcctcctgagcatcactcaaaactaaacagtattaatgaaacttcacttctcttctttctccttagaaaggaggtgatccatccccacgttcccgtagggataccttgttacgacttcaccccaatcatcaatcccaccttagacagctccctccttgcggttaggccaccggcttcgggtgttatcaactctcatggtgtgacgggcggtgtgtacaaggcccgagaacgtattcaccgcgacatgctgattcgcgattactagcgattccaacttcatgtagtcgagttgcagactacaatccgaactgagaatggttttctgggtttcgctccacctcgcggcttcgcttccctctgctccatccattgtagcacgtgtgtagcccaggtcataaggggcatgatgatttgacgtcatccccgccttcctccagcttgtcactggcagtctcgctagagtccccaacttaatgatggtaactaacgataagggttgcgctcgttgcgggacttaacccaacatctcacgacacgagctgacgacaaccatgcaccacctgtatcccatatatctatctctccatctctggagcctttatgagtatgtcaagacctggtaaggttcttcgcgttgcttcgaattaaaccacatgctccaccgcttgtgcgggcccccgtcaattcctttgagtttcattcttgcgaacgtactactcaggcggagtacttactgcgttaactgcagcactgagatttgactcccaacacttagtactcatcgtttacggcgtggactactagggtatctaatcctatttgctccccacgctttcgggactgagcgtcagttgcaggccagatcgtcgccttcgccactggtgttcctccatatatctacgcatttcaccgctacacatggaattccacgatcctctcctgcactctagctgcccggtttctatggcttactgaagttaagcttcagtctttcaccacagacccttgctgccgcctgctccctctttacgcccaataattccggataacgcttgccacctacgtattaccgcggctgctggcacgtagttagccgtggcttcctcataaagtaccgtcactcggataccattccctgtatccgcctttcttcctttataacagaagtttacagtccgaagaccttcctccttcacgcggcgttgctcggtcagggttccccccattgccgaaaattccctactgctgcctcccgtaggagtctgggccgtgtctcagtcccagtgtggccggtcaccctctcaggtcggctacgcatcgtcgccttggtgagccgttacctcaccaactagctaatgcgccataagtccatcctctaccagtgccttggcacttttaataaacttaccatgcggtatctttacctatgcggtcttagctatcgtttccaatagttatccccctgtaaagggcaggttacttatgtattactcacccgttcgccactcgggcattgctgcccgcgttcgacttgcatgtattaggcacgccgccagcgttcatcctgagccaggatcaaactctccattgtctctttatctttacaatctttcgtttgtttagctcttctttttctcttctatccgtttccggatccttctttgacgtgtgtttcttaattctgtttagttttcaatgatctctccacttttctcaagtgcattaacattctatcactattattgatgaatgtaaagaattttattctttttttttacaaatttgttaaaaaatatcttttataataaaatctaagctaaaataaagctcattttacttcaaattccctattttttagatgattattaacataacgataaaacatctgtatttttaataatatatcttttcattcactttgtaatctaaaatctactacttatgtaaattatactaaactctacaaaaaaagagactgctgtcaaatcttgtttagataaacaacattttctttcagtctctttaatttattttttaaaccattctatttaaacgcatccgacgctttttagcatcagctaaacatttgtccattaattcttcagcatgaactggattaacttttgataattgtgcaaatcgattttcagataataggaaatctttaaatttatcaaagtcaggttctttagaatctatttgtaacggattctttccagcatcttctaaacgtggatcatatcttaacaagttgaaatatccacaagccacagcatctttttgctgtctttgatgattagctagaccacctttgattccatgttccatacatggtgaataagcaataattaatgatggaccattatatgattcagcctctttaaatgctttgatagtttgcattgggttggctcccattgcaacttgagcaacatatacatgaccatatgccatagcaatttgtgctaaatcttttttagctactgttttaccaccagctgtaaatttagcaattgaaccagcttgtgatgatttagatgattgtccaccagtatttgaatacacttcagtatctaatactaaaatattaacgttttgatcactagctagaacatggtctacaccgccataaccaatatcatatgcccaaccatcaccaccgatgatccattgtgatttacttactaagtcaccttcttgacttaataattctttaataccttcatttttagaagcaacgatcaatggtaacattttatcaacgattgctctttcttgttcacgattacccttatttgcaacatattcatctaataatgtttgtaattcaggttcacaatccgctttattagcatcaataacacttaataaatgatttgttttataattttcagcaagcttcattccaaaaccatattcagcattatcttcaaataatgagttagcccatgctggaccttgtccatttttatcaatattacatggtgttgaaggagtagaaccagtatagatagaactacatcccgtagcattagcaatcatcatatccttaccaaataattgtgatgctaagcgataatatggtgtttctccacagccaccacatgcacctgaaacttcaaagtatggtctcataaaaccaacaccttttactgtagttaaaggatatttatcagctttataagcaacatgttcatacatatgatctgctaatttagcatgttttaattcttctttcaccggtaccatttcaagagctttttcgccttttttaccaggacattcagttacgcacaatccacaaccaacacagttatcaggtgaaacttgaattcgatatactaatccatcaacatttttacccattggttttaaaacatcatcactgatattttctggtaagtctgccatttcttcatcatcaatcaagaatgctctgattgttgcatgtggacaaaccattacacagttattacattgaatacagttttcttttttccaacgaggcacttcagtagcgatagctcgtttttctttaatagcaactccagatttcattgaaccatctaatttatccataaatgcagaaactggtaaatcatatccatctaatttattaattatagatacaaaattatcaaaatgttcatcaccagttctttcacggcgactagttactgtcaaatctttccagcttggatcaaccttaacttcaacaatagcatctttaccagcatcaatagctttataatttagttctacaatggcatcaccttttttaccatatgtctttttagccatttctttcatatatgtaatagcttcatcaattggtaagatttgtggatttaatgcaaagaatgcagattgaagaatcgtattagttcttcttcccataccaatttcatgagcaatcttattagcattgataatatagaatttagcttctagatctgccaattgttttttcaatttgtttggtaaataatctacgatctcactttcattaaattcagtattcaataagaaagttccacctttttttagattctttaacatgtcatattttaaacaatagttgtctagagaacaagaaataaaatcagcattattaacataatatgtagctctaattggactatgtccaaatcttaaattagagcgagtcgctccacctgcctttttactatcataagcaaaatatgcttgagaatataaatcagtatgatctccgatgattttaattgctgatttattcgctgaaactgtcccatctgatcctaaaccatagaataaacatgctgtataatcagctttaacattaaaatcaggatcttctttcaacgataaatttgtcacatcatcattaataccaattgtaaatgatgtaaatggatcatcttgcaataaatgatcataaactgctttaatttgtcgtggtgtagtatctttagaacccattccataacgtccaccaacaattgttttaacatggtctacatctttcaaaacactacatacatctaaatatagtggctcacctgtagctcccatttctttagtacgatctaacacagcaactttcgctactgtatctggtaaaacattcaataaatattttgcagagaatggtcgatataagtgcactttaattaatcctacacgatcaccgtttcgactcatttcatcaattgtttctttaattgtttcagtcactgaacccattgcaataattactcttgttgcatcaggagcaccataatatgtaaacggtgcatattctcttcccgtaatttcagaaatctttttcatataatcagcagcaatttcaactactgcttcataatgtttattttgtgcttcacgtccttggaaataaatatcatcattttctgccccaccacgttcaatagggttaatatgtggatttaaagcactctttttatatcttgcaagcgcttcacgatctaacaaacctgcaagtacatcataatccataacttcaactttttgaatctcgtgtgatgttctaaaaccatcaaagaagtgcattacaggaacagatcctttgatcgcagttaaatgagcgattcctcctagatccataacttcttgaacagaatgtgaacaaatcattggcatcccaacttgacgacaagcataaatatcttgatgatcaccaaaaatatttaatgatctagttgcaagtgcacgagcagatacatggaatactccaggtaacaattcacctgcaatcttatataaattaggaatcatcaacaatagtccctgtgacgctgtaaaagtcgttgctaatgccccaccttgtaaagccccatgaacagcacctgcagctcctgcttctgattgcatttcgattacattaactggtgagccaaagatatttttctttccttgagcagcccacgcttctgcattttcagccatcggagatgaaggtgtaataggatagatacttgctacttctgtaaacgcataagccacatgcgcagcagcagtattaccatccattgataaaaactttttagccatttttttaaatcctccttttgcataaatacattatactacggcaattatttatttgctagttataaattgccaaaaccgccattcaattaaaaagtattcaattgtcttaatcttttaaagccatatatgaagccactgctccaaataaatatataacagtattcaaaaaatctcctataaacatatacttcacacaaaacataaacatatttactaatatctgtatattaaaatatggcagtacaatgcacatataaatagtttgagcaaaaataattcctaaaacaaaagttacaacagacataatagctagtttttccccacttttattcaaaactcttctaattgctcgagcctgcaatattccaacgataattgaaaaatatgagaaattaatacctattttagctattatccattccatgattattcccaaaacagctgtaacgatcaatcccacaactacagctatcaaataatctttaccataaactttttcatcattatgctgattaaaaaacgcctgagcttcttttctttccttataatcgttgtatttatccctaattttcatcattatttaccttttacaattgtttcaatatattcttgaaccttatcttttaaatcatcacgatttaacgcaaaatcaatcgtcgctttgataaaaccaaatttatcaccaacatcatatcgaattccttcaaaatcatacgcataaacagcttgaatatccatcaaacgttttattgcatcggttaattggatttcaccaccagcacctttttcctgagtttctaacaactcaaaaactttaggagttaaaacataacgtcctaataccgccatatcactaggcgccttatctactgcaggtttttcaaccatatcatttaattttaccagtcttcctgcactctcaaccggatgtgatttagaaggactgacgattccatatttatttacctcattatgattaactgtctgcactcccacaactgaagcctctttgctcatataagcatcgatcaattgtttcaaagccggtttaccattttcatttactacaatatcatcacctaataataccgcaaatggttcatcaccaataaatgatttagcacataataccgcatgtcctaatccttttggttctttttgacgaatataataaatatttgccatacttgcaatatcctgaatcattttaacctgctcaacttttccagcctccattaaacgggcttctaattcataagatttatcaaaatgattctccattgcatgtttattagaattagtgataattaagatttcttctatcccactatcgaccgcttcttgaataatatattgaattgttggtgtatcaacaattggtaacatttctttagctaatgctttagttgctggcaaaaatcttgttcctaatccagctgctggaataatcgcttttctaactctctgtttcatctttttctccttttcatctataaatatattttactctaattaacaatgttattatatgtcgttgtttgctttttccaaatatttaaaggcataaaccgaataatcagcagcattacgataaacccgccaatcattcctgaaatatgtccagctaatgaaattgatggaatcaaaaatgaaatcaataacattaataatacacttgaagaaatttgtttaaataaataagcatagatatttttgaattttatcgctaatgctaatagagcacccatcaatccaaatatcgctcctgaaattcctcccatcacactattagcaccattacctgtagcgataaaatacagacatggtaataaagtcgttgataacgccgatactcctaacacaattccataacgcttttgtcctaacaaatactccattacagaacctaaattaatcaatgaataacaattacaaaaaatatgcattaaaccaaaatggataaagttagctgttatcaaacgataatattgtttaaaataaactactaaaatcggattaaatccaccgcattcgatcccctgctgagcattcatatccaagctatacttgaatgtcgtataaccataaactaaaacacatatactgactacgataactgtgacaggatacttcttataatcaaatttcatactattctcctataaattcaaatattgacatttgatcaatatttacctctgtatcttctaagattcttttattcttctcatatatcatatcaaatgaaagatccgctaaaatatctttaatataaattggtgtaacccccatatctaacaaacgatcgtttcctaaatatgatccttcaattgctaaaggaatagtccaattgttatgaagattctgcaaagccgtaaaccaggttgccccattatttatactgctcgaaataacaatttgatatttagaaagggcacaaacatagctattgcgatcaatagcactagtgatattaaaataactattgggatcttcagcactcaacatcaccaattgtcccgtttttagatattttttatattcattttgttttgctgtcaatctttcacaaacaaaactaacacatttgcacccctgttgtaaagcataatgaaatgcaacttcatcgattcctttactatcattcgaaatatacactaaatcattttcgcttactttatcaatcaaacgtttcgtgtacgttcgatcttttttggttactttagttaaacccattaatgaaataccatctttagtaatattaatatcgccacaataaaataaatataatggtgatctcttttttagctgcttaactaatctagccggaaaattatcttcatatttagttgtaacattaattccgttactttctaaattatttaaaacacttaaaaaaacattaactgttgccaaacgtttgaccatcttatcagcaataaattcatcaatttctaaaatatcttctaaatcttgttgcgacattgaaagtaagcttgccggcccctttaaatctttctttttaataatcttttcaactttcaaccattcatcagtacttaaaggaatttctttatacgcttttaaatgagcacaaaacagcatcattgcaatactatcaaaattcaatttaattcgttccataacagcatcatctcctagtactcatcaaagattcgtctaatttcattaatgtttcttgttttacttaaagccaacattaataacactcttgccttttgacccgaaagtgtatttgaaggaatacaaacattattaggatcaaaaacatcgcttttatagacaataccttgatttactcgtgaagctcgaacaaacactattccctgattagtcaagcgctcaatttcctgcaaccatacctgactataattaccactaccactgccaataattacaataccctggtgttcatctgccattgtttttaaaagatcaactttagccccagcataataataaacaattcctaccgcaggtaattcttctggtaaatccttactaaaaactgattgtaaagtatgttttttaaaggttctcgaaaacatcaacactttatcatcatacatatatcctaaacagccaaaatccttttgatcaaaagcatcgattttaaaattactcactttttgaatatctcgtcccgaataaatcgtacttgaaaatagtgccatcacgccatgtcctaaagcttcatcacttgaagccaaacaaaccgcctgatataaattcatcggtccgtcagcactagtagcactagccggacgcattgctccagttaaaacaacaggtttatatgtatgaactgttaaatttaaaaaatacgcagtttcatctaacgtgtctgtaccatgtgtaactacaataccatcaacatcatcataatttgctagttcattgattttttttgttagacaaagccaatgtttctcatccatttcattactatcgacattaaaaagctggattgcccttaaatttgcaacttcattgatcatcggaattgaatcaataatttctttgatatctatctttcctgcttgatagtctgtcgctttacctatctttccactaccagcaatcgtgccacctgtagctataattactatatttttcattttatcaccgttatcattatagcaaatttgttgtagtataaaaagaaaaaacgtctctttgcattaaagagacgtcttcgttattatttatcagctactaatactttatcagtagtatgttccaaaataatttcttcagcagcagcttgagcagcagcaagacgcgcaatcaatacacgatatggtgaacaagaaacatatgttaatcctgtcttatggcagaatttaatagattctggatctccaccatgttccccacaaatacctaatttgatatcagggcgaacactacgacctttagtagcagccatttcaactaattgtccaacaccactttgatctaaagatacgaatggatcaacttgaattactttacgatcgatatattcaggtaagaaacttccaatatcatcacgagagaatccaaatgtcatttgagttaaatcgtttgtaccaaatgagaagaattctgcatgtttagcaatttcatcagctgttaaagcagctcttggaatttcaatcattgtaccgatcttatattcaattttagcatttttagccatgattgcagcttcgattgcttttgtaacattattttttacataaacgatttcagcttcactaccaattaatggtaacatgatttctggtacgatagtgcatcctaattctctttcaacatcaatagcagcatcaataatagctttaacttgcatattatagatttctggataagtaactgccaaacgagaaccacgatgtcctaacattgggttagtttcttttaaagtagctcctttagtttttacttcttctaaagtcttacctaatttatcagcaactgcttgatattcttcatcagtgtgtggtaagaattcatgaagaggtggatctaataaacgaactgttactggtaatcctaccattgcacgatagattcctctaaagtcttcaacttggaatttatataattcatctaatgctttaactctttcttccactgtatcagataagatcatttgtcttacatattcgatacgatctccttcgaagaacatatgttctgtacgacataaaccaataccttcagctccaaatttgattgctacagcagcatcacgaggactatcagcattagcacgaacttgtaattttttgatttcatcagcccatgacattaattcagcgaaatctcctgttaattctgattcttcagaatctaatactcctaaataaactttaccagtagaaccatctaatgataattcagttccttcaggataagtattaccatcaatagtaaatgttccagcatcgtaatcaattgttaatgctttagcaccaacgatacagcatttacccataccacgagcaactacagctgcatggctagtcataccacctgtagaagttaagataccttcacagtcaaccattccttgaatatcttcaggagaagtttcatgtcttactaagataactttttcaccagtaacagctttttcatgaactttttcagctgttaaatatactttaccagcaccagcccctggtgaagcaggtaatccttcaacaactggatctgcagattttaaagcttcagcagtaaagtttggatgcaataactgtgaaatttgatcaggctcaacacgagtcattgcttcatatttattgattaaaccttcatgtactaagtctactgcaattttcaaagcagctttacctgtacgtttaccattacgtgtttgtaagatgaataatttaccattttcaacagtaaattcacagtcttgcatatctttgtaatgtttttctaatcctttaacgatagtaactaattctttatagatttcaggcatatcttcttctaatttagcgattttttgtggtgtacgaataccagcaacaacgtcttcaccttgagcgttgattaagtattcaccataaatgtgattatcaccattagcagcattacgagtaaataataccccagtacctgaatcatttcccatgttaccaaataccatttgttgtacgtttacagcagttcctaaatcatgaggaataccgtttaaattacgatagatgatagcacggtcattattccaagatctaaatacagctaaaatagctcccattaattgttctttagcttcttgtgggaaatctcttcctaattcagttttgaaaatttctttatattgaggaataatagtattttcaaaatcttcagctgtaatatctaaatcactttcatatccatttgctgtttttaattcagttaatttagcttcaaataattctttgtcaacttcacaaacaacatcagaatacatttgaataaatctacgataactgtcaaaagcaaaacgacgattaccagtttgtttagctacaacttcaacagtctcatcattcaaacctaaattaagaattgtatccatcattccaggcattgagaattttgcccctgaacgaactgaaactaatagagggttatccaatccacctaatttttttccagctaatttttctaatctttctaaacattcatcaatttgttttttcatttcatcattgatgatcttaccatcagcataatattcattacatgcttctgtagtaacagtaaatccttgtggtactggtaaacctaaattaaccattgcagctaggttagcacctttaccaccaagaaggtcacgcatcatttcgtttccttcactaaacatataaacatattttttcatttaatataatcctccttagaattaatccatgtgtatattatacacatcttccccccttcattcaagtggaagcgctttgaaattatcatattttgttataaagaaaagactgtattattaaaaatacagtccttccttcatccatatttatcttttatttgcaatttctatttcaattttacgattatttatcttttgtttattacattttttaataactttattaactactttcttattaatatcaacaaatgtaaacttacgttttatatcaatatccccaatatcttcttttctgattccggctttactaacaaagaaattaatgatttgagggactttaatacgatccattgatcccgctgtaataaagattcttgtctgatctttattattctgtctttttttctcctcttttacttcttgaattacatcacgtttataatcaaaacctaattgagcttgataattcatatataataaagccgctgtaaaatcagctaacatagttggatcgatttcattgaccagctgtttaaatttcttatgattaccagctagaatcacatcttctacatcactgatcaacattcccatcttagcttcagaaatctctttaagagtcggaatagcatctttagtaatcgttgattttgtcactctttcgatctgctttaaaaaacttttttcttttggggtaataattgaataagcaattccttctttatcagcacgaccagtacgaccaattcgatgtacatatgactcaatatcctgaggtaattcataattaattacatgagtaacattttcaacatcgatccctctagccgccacatctgtagcaatcaaaaaattgatcgtgccttttttaaatttgcgcaatgtattcattcggtgattttgacttaggtcaccatgcatcgcttcgacattataattagcctgctgcatttgttcggtcacttcatcaacacttcgtttagtccggcaaaaaattattccagtcttgacattggctacatcgatcaaacgacataatgtttcaaaacggtctttttgtcttacttcataataaaattgttttactgatgtcgctgtcgcttgctttgacaatactgcaacatgttcaaaatcatcgtgcatataattttgagcaatctttttaattcctgctggcattgtcgctgaaaatagaatcgtttgacgactatcatcaacttcttttaaaatcatctctatatcttcgacaaatcccatattcaacatttcatcagcttcatccagcaccacaaattttatatttgcaagttttaaaactttacggcgcattaaatccattactcttccaggcgttccaacaattatatcgatccctttttttattgttcgaatttgtttttcaatatcacttccaccatatacacaggcaattttgctaccgttatatttgcctattcgattcatttcttcatgaatttgcattgccaattctctagttggtgaaagaattattgcttgtggcaatttatcattagcaggttctattttagataaaagaacacttccaaacgctaaagtcttacctgttcctgtttgcgcctgaccaattatgtccaccccagtgagtaagacgggaattgctttttcttgaatttgtgatggtttagaaaatcccatgtctactattgcttttaatacttcattacttaatcctagttgttcaaatttattttcaatcatcgtttaatacctttctaattactttggtgagtatagcataattattcattatatacaaacctatttttagaaattcatctatttttatacaaaataagattattgtcattatcctagtaattatttatcattactgttataattttgacaacaatttaattggaggaatttttatgaataataaaattatttggcatgatcgaaaacacttcatgtggtttccttttagttttacaaaatatgaaattaaaaatgaacgtttgtatcaacagacaggattgatcagcactcattatgatgaattacttttatatcgtattaccgatatatgtttacaaagaacattagctcaaaaaatttttgggactgggactgttatcttgtatactaaagctgatagtagtaaagaagttcatttaaaaaacatcaaaaatgctcatgatgtaaaaagcttgatctctaatttagttgaagaagcacgtgataaaaaacaaatagttggaaaagaattttttaatgatgcttataacttagacgatcaatttgactaaactgtaaaaacaaattatttttaatgattttattgcatatagtaggcaaaaaggaagtttattaacatttcaataaacttcctttttacttctactttatctatcatatagcaacaataaaatattatatcacgattacattatccatataactttttattacttttcttaaactttattctatacaataagcagatctattttattccaaatatgatccttatttttttatccgatatcgaccatcagctatatcataaatcaaatatttatcatgattcgcaaataaataacccccgtctacatctttaaacatatacatcaaacgattcagcgcgttataaatatattcaaaatcttcacttctaattgtatcatcttttccagacaatacaaaaatatttcgattaaccccctgataccctttaaaataagcacgattcatatcataaaaagtaatcaagaatttataagtaccgttttctaattcttttacagtattaaacaaacataattcatatttatcatccagcatataataagttaattttactgctaaataattctttccattttttaaaagatgataatggtattctccaccgaaattaagcgtttttaaagattcgtaacaatcttttaatatattatcaataaatcttctttgctccttacttaaataataaatttgtttaggtttagctttatctactttttttaccaactgtacaaacttcttcatcacagcatcgttagcgtccaatatataatcccaaacaattatctcaatattacacggatcagtttttttgcctgtatgatatatcaatttctgatctaattccaaataatccttaattttaacatcttcttttttattttcagctgcaataacaatattattatgtaaaaattcataaaatttacatctatttaataataatctatcattaattatctcacttaatttattgaatgttatattttcatcaacatctatagttactttattttctttataaaatatctttaatctatatctattaatcattttatcccccataaaactactcattcactttaaaaagaacagctgccatatgtttacagttattcccactagaagcgtatgggcaattacatgctatttttcttattcttttttcttttacctcaacagaaaccatatatttagttgttccatttaccgaagctacgatatgttcagtactttgataaataatatcaaccattccatcttgaaaatattttatacctctttcaatgatccaaggtttaaataacgatttccaatcatcgatatatggtgaatttaaattacgtttattcgtattatatgcttcaatttgttcaaaacaaaatctagttgcttttacatcctctaaagcatcatgagctgtaaattcatagccatagtattcagcacaaacggtcaaagatttccatttatatctaccacgattgcccatctcaccatagataggtgcgaattctttcattggatctctaaatttatatttttctacatctacgccataattctttaatattccctgttcaaatgcaatattgtaacaaacaataaattcacaattatcaaagatatcttttactgcatcgatataatcttcaaaactaagtttatccttaacatcagatggtgaaataccatgcactctttgcgcattagaccaagaaaaatgtctttttggcttacacaattcattaatcaaaacttccccatcctgattaattattgctacttgaactacttcatcatcatgatacatattaataccagttgtttcaaaatctaaaactacgtatctatttctcatacctacacctcatgctttaaagtttatcacaatttatcaaatcatgccatctatattatcaattacccataatatataacaaacatcataaataaaactttaaatttaattcaaacacgttttaatatcaaaagaacaatcaataatgattgttctaacaataatttgacacatccaatgttgttattaaacatgactgctgtagctcgacttgcacctatgaatatattttaatacatctaatgttgatattaaacagattaaagatactgcatgatttttacagaagcggatttcaatacatctaatgttgatattaaacctatgctgatcagttacaaaagctaaaaattatgggatttcaatacatctaatgttgatattaaacagattaaagatactgcatgatttttacagaagcggatttcaatacatctaatgttgatattaaacgtacgagctcgatgcgcgtggtggtactcgttacgtatttcaatacatctaatgttgatattaaacaatcacccccctttacttcttgttataaagggggtatttcaatacatctaatgttgatattaaactcacacgaatcacgatgagactgtatcatcgcgtatatttcaatacatctaatgttgatattaaacccacatgcataaaaacgtaaaacattatcaaacttcatttcaatacatctaatgttgatattaaacgttaacccccctacgtttaggggtggtattagattgatttcaatacatctaatgttgatattaaactatcctttattccatgctttattaactaattcagacatttcaatacatctaatgttgatattaaaccttcgataataacgtcatcatcgtagttgccagtcgctatttcaatacatctaatgttgatattaaactcaggataataatatgcttcttatttcattaacgcaatttcaatacatctaatgttgatattaaacacaagatttaacctaagggatttggttaaatacgcatttcaatacatctaatgttgatattaaacactgcaattagcagcatcttagaaaatttcacaatatttcaatacatctaatgttgatattaaaccctagtaaattagccacttttcattttttattatacctcaaagcttatatatatcaacaactttctatttttttaccagctaaattcttctttttataattttctatcatattctcctgaacccttactctgacaagaggtttagacattttattaaaaattttacctggtaaattatataattaaactatctgtattctcttctttttgacatcctaatatttcttcatcaaataaactttcactttgtaatttaattatactgacacaatcctcatccttatttatagccttttgtaattctttcttcaacaaaattaactttgctggtgtgatagggcctttaaaaatagaatactgataatggggaagatactttttacaaatcttaaatattttattaactcttttttcaccaatatcataacaaacaattacataattatgattttttattttcattagtatttatcctttattgaaaatggtataaaagtggtaccttcaaaaattgttttaattaatttatatccgtcatattttattgctgttttatatgatatttttctttttaattttgtatgctggaatttagtatctatcctgttttcaaaagcttcaataaatatttgtctaccttcttcatttaataaacaatagttagtttttttatcaaaatgtttttcaacttttaattttctagtatttactaattcaaaaatagttttaaaaactattattggtttaaatacttcgcttagatctaatgataaagaaaatctttgttctgttggttcatgtaaaaatgaaatactttgatttaaatgagtttgatatatcgccgaaattgtttttgtatataataatgtgtttccaaaagaaatcaaagcattgattggattatctggtggtcttttaactctcttattcattataaaatcttcaggtaatatatatttaaaagtactataaaatctttgccacaactcgccttcaaccgccattatttctttaatattattagcatcttgtaaacgtctagaaacttcttttcgaatccagtcaatagtttctttaacttcttttttgccatgtttataataatgatacaaagtttcatcaatattaattgctattccatgaacgatcgcactagcaatttcttttctatgattactaaatgcttcaacttgtttaatcaataatttaccactagtatatttatctttaggataaaaagttccactatagccctgatagtaattaaaaaaatgaataattatattttttgatgaaataaaatccaacaatttagtattcaatgatatttcatttaaacaatatatctcttttacattttctactggtaaatagatatttttattaccttttctaaaacaaagtgaatcgtcttttcgctttaaatcacccatactagttatatattttgtacttcccataacctcacctcctatatataacaataagcatagtatgcacattttttacatttactctcatttaaaactggtggtatttgattaccttccaatagttcttcaatttctacaattactttatctaatttctgttcttctacagcatttaattctacttcaataaaagatttattttgtttatttttttcaattacttctattctaccttttctattaattcctttcgattttaatatcttaagataatacaaaagctgccacttagcggctatcaagtcagcatcagatttttttgtttcgattaagtatttagccgttaatttatctaatcttacattatctattgctatttctgcatttttattatcgctatatttttgttcatgcaaagctttcccaatttttacatcttcactttcatcttctaaattaagacgattaccatgtaaataacattgtcttttacaatgaaaataataatttatcaatgtcccatttatttgcataatcacaccacctatataaacaattcattttcagtttcaaacaaaccagtatttaatttgccatctaaaatataattatcaccatcttcaatatagaaaatatcaccaatttgctcttcataatcaaattgacagttactatcaacttgatacataaaataattcattttactttttacaaccgataattgataaatctttttagaataatccatttcattatcctgcaataattctacatactgcttccatatcaaattaccatcatattcatgaccatcaaaatcctttatctttcgccctaaaaaaatcgttactcgatctcttgtatctaaaattaattccatccgtttacttacttctttataatttaagcaggcagcagcctccctaaaaaagtcttcaacattaccatcattatattctttagccttatgttttaaaactgtgagtaatttttgataatattgattaaaactcttatttaataatacagctttcatttcatcatttaataatgttaaattttcggcaactctttcatcctttttataaatatttgcagctttatttaaattaaagaaatacactaccccatcttttaaacaagaacgatttattctccccataaactgttcttcactatctagttttgaaatatctttataaccaatatccatatcaatatcaacacccgcttcaactacctgtgttgctactaaaataagatgattacaagtattaaccttatctattattatttctctttccaaaatactgtcaaaaccgctaataaataaaacttcacaatcaagattttcatttttaagacgccgataaaatttctcagcacttcttcttacaataaactctaacataatttttttctttagtttattcattttcaaaacatgctcaaataacacttcttcaacattttttacttccaacaaactataatcaatctttacccgttctttaaaaataggatttaaaaaatattttttacaatctttaattaatgataccgaattactatcatcatttgtaagtacttctaaattaggtaaagtagctgacataataattattttcatatttaagattctcgcgtattcctttaaaaagataattatttcattccagcgttcaattcgataattttggatttcatctaaaacaatgacagtattaacaaattgataaaaaccaaatgctgattcacggttattgccaaatagtgtatcaaacaaactaacatgcgtagttaaaataattggataattcaaaaactgacggtctaataaagccttttgatatttattaggtttattttcatcaatcttaattggcgttgttgaattaacaactgcaacattatttaaaatactgctatgatcaaatattttattaagtgaagcaatattttgttctactaatgtattaaaaggataaacatagacaattttgtttaaatcattatttttttcaattaaacgtaaacttaagtttatcgctgtattgcttttaccactgccggttggtgcttccaaataaaaaatatttttatcataattttctattagagttttttctgcttctaaaaatatctcagttcttaattcgttgatactattttctaaaatctgcttttttctaattttagttatcaacttggtgttatcatattgtttaatcagttctttaaaatcaaaatcatttatcacattaatgtctttttgattattataaaattcacttgttgcatagtaatcgcatgtaactaaaatagaatataaaagtctaacataagcatataaatcaatttgtttattaagctcacatttttttaattttttaaataaaccatttctcccattcttttttaaaggaacaaaattaaaatctacattaaactgacttacaaattcatcgctatttacccaatctataattcttttttctaatttatcatcactatcaaatttatcaataaagtaagttctaaaatcatcaatcttactatgatgcctagaaattacaaaagcatttatataagtaattcttttcaatattttataatcatttttatcgagtgaacttattttatttagaaaatatcccaaataaatatatgctgataatatcgagtgattagaatctaagttttgtggcggtgtcatataattcatagcacgattattcatcttatcattttgaaaaatgggatttattttaccgctatcatggaaaacgatcgtattaataaaaagttcattaaacacttcttttccttcatcagataaatcactaactaaattatttttaaaagataccattattttatctaatctttttaattcaaaaatttcttttaaatatttaatacacaattgaatatgttcaacaatcgtttcatgctgctcatctttaatatggccataacaattattaatatttttcattaatcgttctagtgacaccacatatttatcaatatccataacttcctccttcaataaaacccgcaataaagcgggtctaataaaatattatatttttactatcaaaagtatatacagtcccttcatccatcaatagatccgtatgaataaaagtcatgtattcatataatcctgttttttcatttaaaccaattggtaaactctcctgatacttataaaaatcgatatcaatatcctcagcttcttcaaaacttcctttaggaaataaactatcaattctttcttcatcaatatttctttcatccaattcaacaatataaacatcatcaattattgcaggatgatcattttttcctaaataaggaatatagatacacttatgattaattaatgactcagcaatttttttagcttcctcattatctaaaaggacaataatatcccattttggatattctaaccactgttccttaacaatcagatttccaccctgctcttttgaagcatatcccactgaattattaaaatactgaatctttttagaaaaataaccttttttattttgcggtataatagatacttttacatcctttagttttcgataaaactccggtagttctttagtattatcataaccctgataccctaaaatagcgccaaacattcctagcaatgctactttatgaatattaccaaatgtaaaataataataggtattgacttcaggtcgcctaaaaaaagctgttttaccacttaaagtaaatttaagtgcctgcataaattacacctcttttttagtgatgatatgatatatcttggcattttttaaattagattctaaaactgttgtttcgggattataatatatttcaatacttaaaatatcatcaagttcatttaacatattacattcaattttaattttgttaagatcagttttttcaaaactaatatattcacttaaatttggtaaatatgtatctgacttagtttcgacaaataaagcaaattcattttcacacccttctttagcattagaagaaaatgaagtagctgctactaaagctgttcgtttaaaattttgatagtctgcttcggtatacccatcagttacctttaatgatactagttctttataggcattaggattgattgaaaaaggataaaaataatgcgcttcattactaacgatcttcgttcctaatgtagaatttttagcttcctcatctttttctttatctttagaagcatctctaaacggtgataaaatttgctgttcttcagcaacgctgccatcgtatttattaattccctgaccaaactgaacagcaccagtaattgaaatattattcttagcttccgcaaaagtagctccaaagtttttaacatctaccgcactcattaaattagtgaaaacttctttagcatctttacattttgataaatcttcaacatcaaataacttttcataacgttcttttaatgaattaggtactaatgttacactaccatctttttgtggtgaaaatttcattgattttatgtataacacttttttaccttcactatcccacatctttttcattggatattttaaagctttgtcactgccaaaaaccgttccatctgataaactcttaggataaccggaaaaatccgcattccaattagccattattgaggcaattccaataactccatatactcttttatccattttctttttcccctttttcataaattaaattttcaccaagataacctgccatcaacatactttgatcaattttcttgacatccatatattccatgatcattgcaaataaataattaaagcgcgttttccctacaaatagatcataattataacgacgataaaattgttccagcttgattttcaaaaccttatcatttctaataacgatgaattgattaataatatcctgggttttattctttgttttactttttgattgcaagtaagcaatagcttggccaacagcaaaactatattccaaatcatcttcaattttcatttgatgttcggcatttatcttagttcgtaaaacatctcgtatatcttccatatcattctccttttgattaaaatacttatttaacgcaaaatataaattcatttgtttcttcgcactgtttagataacccattttgattgaatatttagttatatccaaggcagcttttaacaaaacatttccaatattttcaacttttcctgcatatacccaagcatgaattgcttccctacaagccaaaagattctttttataaatactatcaacgcctttgagatcatcaggagctgtaaaataattattttttaaatatttagaaaataatatctcattaataagattttcaacatctgttcttttttcatattctttataacattcatcatccaaagaaccaataacatttttataattaaataaaggttttaaaaaaactttataatccgtaacaacatccatataatgaatttctaattctttacctttttttgttttaacaacgatcccatcaaaacctttttctatatttttaatattatttaaacaataaattcttttatcatcatcttcatcactactaaaataaatatttgttttaccatcatttgcctgattcatcaaaaaatcaaaaaactgcttttcaaataaagcttcttttaaagataatatataaggaatcttattcattctcgttttattttccaaaaatggttttttagaatttaactgcatattataattcggtaagccataaacatcattaccatcataaatattataatcattacaattaaatatcttcgttaaagtataacgatttccctcattaatatataactgatcatcatcctcaaaaaagacctttaaataatctttttcactataatcaactttatctaaattatatacattttcaatcaaccattgtttatttcttagtaacttctcctgatcaatttcaccaatatcatcagctacaaaattatacatttgtaagtctttacctttatatttctcctggggattctctaaagacttaaaatatctttcaatcgcttcattattcatcttgccattgttaaaactttcctttttaacaaaaaatgacaaataattattagaatggattgttttcccaggatcctgaggtttattcatacttattaattgactttgataatcataaaaacataattttcgatatatttcatcatcaggcttttcaatcaaacaatgatccttttttgaatacttgattttttcaacctgataactgccatcactatgtaccaaaacataatcaccattcgttaaaaccattgtctccaaaattaaatttggattatttttaagttcctgactaaaaatttctagacactcttccagcatcacatagcctcctttcaataaaatgaataattaacaaagccaaagccccgggcattcatttccaaaagtcctgcgccgatggctaacattgccaatttttgagcattttcattttcagcaatatctagttcaatcatatctcctaataatttaattcctttatatgtccgtaaaacaggaactttatttttaaaaataatatgataatataactgaaaatcttcatttattttatcgctagtaatgttattatatttttttattaaatttatttttaagcgcttttcaaattcttccaccttgatattatttttccaataaccatgctcagtttttaatattataggtgttaacgtgtataattttttaatcattttaggctttatgatcttaacctcacctgttaatccctggatttctttggtacgattttttatcaatgtcttatataaatattcagccagcttataatcaacagttcgtattctaaatacataagtattatctttttgatatacgccatttttcgctagaggataaagactgtcaaaagtataaaacttatacatattcgtttcatgaatatttaaaaattcgttttcttttaccaaaacactatctataaaatacgccagataactttgtatttcttcaattttgatatcttttaataaatatatttttatttttaattcatacacattcatttctatgctccctattttgtttttatataaaagattataacttattcaaaagccacaagcaaaagcgcttacattaataacagtaaaaattaatcatttatatttttttatttaaaatattttattattttgtctatctaatcccataaaaataattttttaacatttacattgcctcctttatttaaacatttgtaccagataatgttttaacataataacataatattaatgcaataactctaatatcaacattaaacagactgtatcttatatttaacattatcttagaagcaggcgatagtcccatttttaatagttattaaaatacttaataataacatcgcatattttattttatattatattaaaaaaattatttaactatattttctatgcattcttgtctttataatatattatgttattatataaatatagaaagcgcttttaaatataaataatgacaacgggatgataaaaattaaataaatatgcacatcttttttatagaaacaagtgtatttgtaggatattacaaatgcattgatgatccggataatcataataaagaaatcactggttcttaagccatggctacagtatctatcgactattaaaatttatgaaattgaataaacaaagaaaaatatttagaaaggagattacaattttgctacagataccaatgacagttttcttgtcaaaaaaaatgaaaaagataaacaaaatcagtattgttataatacttttaattctatgttcagcatgcggtagacctcctggattaactgctaaaatgggtcgcaatattaattgtgaatctgaattagggaatttttcaaaatatataaaattggataaacttccaactggtatggataatgaaataaaagcccatggcaaaaaggttgggatacattgtggtaatatgtttacaataactagtgagctgacagattactatactaattatagaatggttgatgccgcagatactttagaagatacttttgagtatggcgcatatactgttaatataaaatattatttatattatgatacatcgattgtcgatagtgatactgatacgccaaaagaagtagagagttccggcctaatggcagaatattacataaaaattgacgataagtatcttagtggtttagagcatggttttagtctaaaaaaaagatacaataatttaaaaaaactatctaaaacatacttagaagaaatgaacttattaataattgaagaacttgatacttatactaatcttaaaactatttaatatcagcaaatctattataaataataaaaatgagaaattttagaattcatcatatttaccaacagacaaaataacttgagaatttaaataaagagactattaaaacatgaggtgatattgaccccacgttgttagaatagtctcttttttagaagcaaatattattatttgttatttcatgccagctataaatatcgatatatctcatttatctataataatcacttatataaataaggtgttcaaactaagcttgaacacctttatatcaatgatcaatagtatgcagttcaacgatctcctgctctaatttacagtcatttttcaacatataatcaatgactttatcatgaaaccgttcttttaatttatttaatcttttacgatcattagccgtcaatctttttgtatattcctgatacttttgtaatatatctatattcatggcaatggttttaaaaggaatattggtcctttcaactaaatgcaaataaatataaaatcccccagcatcaatatcaccaaaatgataataattaagatctgttttaaattgatagattttcaacaacagttctcttcttaatgcattatgataaccgcctaaatagattatcaaagtattatcaacagcagtatcataaaatgaagttaggttttcaatcgttaaaacattagcatctctaatttctaagattttcaataatttaatattttcagtagttaaagaaaagggactattaagtttaccaatatcaataatctgttcatttaaactgattttgatttgaccacttaaatatataaaaccaggatttttaataacattaaaatatccaaacaattcatcttcattttgaaagctttcactataataatcattaacaatattaacaagcttacttttgatattttctaatcgttttgaatctttcaaaaccattaaagaaaatttacgaaatgaaatttctttcttttgttttacaagtgcttgtaaaacaataaatgtatcattgatttcttcaatattttcaatatttaaatacctgcttactgattgatagttttctatcttttttaccatttcatttttaaaacgatccagccagtcgatagaaaatgaaaccccttttaaacaatcaattgtttcaagacgataatcggctaaataaattcgctttattaaacggtatgcctcttttatataattatcatctaatactagtgctatttcatcaattccctcatcatcaataacaatatcaagaagatgtaagttatttaaatcataacaggcttcatcaatcaataaacgctgcgaatagtaatcactgttatcatattttggaaaaagctttcgcaatttaacttttatctgcaaatttaaacaagaaccttgtttggataaaacactgcgttcatacttttccaaaagattagttaatatttttgttgcatatttattcatgaataatagcctcaacaaaagaattatcaccggatttaataattgctagggtggtatcaacataaggcatgatagtactagcacgatctggtggtgctgccaaaatgatctgcacattaagttcattataaaatctcatcattgcctgaattctcgtttcatccatattattaaaagcttcatcaaataaaacaacacagccagaatcttcattaagacgatttttgattaactgttcaaaacttgaggcaataacaacataaaacggtgtttgggtttctccacctgatttttcccgattaactttagaaaatttagtaaaatcaccattttcatgtgaaattttaatatcataatctaaatactcacgataatcagtatatttttgtaataacttttcaccactttcatcttcacctaataaagctatttgatcaaacaattcatccattacagctcgattttcttttgataaagtcgttacaaataaatcatcactgttatactgctgattagaagcaataatatcataataacgtcgataatctttacgtctgctaggattgacctcaaattcatagctatcgccattaaagtttttattttgaagtcccttgttcaattctttaatatcctttttcgcctgattgatcttttcatacaatcgcgatataaatgactcttgaaatgactgctcacattttcttcttgcatttcgcacatcatcttgacgtttaacgatttcaatgtctcttaatttatagtatagctgcaaataaacatcaatactgtcgatcgtttcgccataaccaactttaaattcatgattaaaagctttcatggcccattcaatattcgtattttccttatttaactgtccttctaattcacgaatttttataactaaactgttttgaatcgatgcgtaattatgaccaaaacgtttataatatctttttttaattgccgcaattgcttcgtcaataatttccggtgccttgggaagcatttctaattctgcttcaatttcctttttagttttattattttgatcaatgctggctttttcattgataagattacgctgttttaaatcatagttatcttgggctttttggtattttaggttaacttgatctaattgttggacaatcgcaacaattgaatcatcttgaataatttcttttaaacgtttatcaatctcatcgatattattttgtaaatcatgatattcatcgatcaaactagtagaaccaactaaaaaatcgatttgtgatttattcaagatctttagattccgatttatttcatgatattgtttacttttaactttgatttcatcttgaatttggtttaattgttcttcaatcatccctatttgaatcttcaaagcttccaatccaatatacggctgttgatataccttaggattaagcgctctaaccgtataattattataaaccatacaagttttagtaattgccgttttatgcattggtaattgttcaactgtatcgacacacttaactcgatttaacagcatattagcatatcttttagcgtaactgttaagacttgtaacataattagctaaactgtcttcttgggtttcttgatatttatccagcttagcaacatcgacgatcccgaccccaaaaataccatgactatttttatactgttcatatatctgcattgcttttgtgaaatattcaggatcaataataatatcaaaacgctgggtatttaaatatccctcaatggcattacgccatgattcatcagttatttctaaatattcacaaagtggctttacatcaattttcttttgataataattagctaactgttcttttaaaactttaataagctcagttatttctttacgataaaaaaagcgattacttaaaagaaggttatgttgatcaactaattcattttgtttagtctgtatcttttttaaatcttgttcaaaaataattttcttttcactaaaatcactacgtttacttactagatcattttttatttcaaaaagatgttcatttaaatattcactatcataatcattactattaacattattgataaatgtttctttgattcgaagttgttttaaaatcattgtttcttgaattaatttatcaacataatcatgatatttgatttcaagctgttttaattgcgtttgcttcgtttttaaattgctttcaagctgtttctttaaacgataaccttcattactgtctaaaatattttctaaactaataacttctttttgaagattttcactttcctctttagcaatgatcaatagctgctttaaatctttgataattacttcgctttttaaaatagctttttcaattacttccttttgataatacaaactatccagataaagatgatctttagcatcttggtgattctttaagcgaagatctatcttttgataattttgataaaaagtatctatcttttctaaagccgctaaacgattttgctgatcttttaaaacattacctaaattacgatacgctcttacattattacgaagatcatcgatcttaacaggatcttcatttaaaaggaagtcaaaaataaaattatacacatggttgattggtttaaaagctaatgcgcgaggaatcaattcaaaatatttttttgatacccccaaggcttggcgaaacagccccggcacagcactttttttatcagcataattagcctgaatctttttactagttaaaaagcgtctaaactcattacgattatacacatgatttcctttaataaataaatcatcagctattttttgattgattacttgaaaaaataactcttttttgatatttgatttacttagttccagaacaacacctaataactggctccgctttgtcgtttcatcaaaatattctaaaacaatatacgaaaccacatctcccattcttaaatactcttttccttcacgccctaatttaccacgaatataaccttcaatatttctttttcctgaatcattagccgcactattaaacttagcttttcccgctgttaaaatatactgcaaagcatctagtaaagttgatttaccagtcccattttcccctgtgataacggcattatttttgatttcgatcgtttgattattaaataaatgccaattaatcaacttcatcttgactagttttttcactactatcacctcgcttttgataatccaataaaatatcatcgatttgttctaagcgttcaaccggtaagacatacgtaatagtcggataaataataatgactgcattatcatcatcactattaccagttacatcgataatattatatctttttaagaccctaaacacttctttaagttcacttttattaattcgtttatcaaaaataccagttgcattaatagcatcatgaagctgttgtaaagttattgtgatattatcaagcaaagatacttcctgcattttttgataataaaagcgtcgtaacaataataaaataaccgactcatttttcttaaaagaataacgattataattttgtaaattatataaattcaatactttatcaacattatgattttccaacacataatccatcaaggcaaaatagctggcataaagctcaaaatcagcaataattttataataatcatcaagatctcgaggtcggctggcacaaatgtaattatagcttaataatttattagttaatcttgaaaactcttcttttttactatcatttaaacgaatatatttattataaaaagttgtcgcctgctgatatttatccattcattttctcctttactttaaaatctttaaagcgataattattaactattacttcattatctaatggttcaacttcatattttgttccatatgtaaaaccatataaataaatcaacactaaagtcgctagatcttcattattgttgattggtaatgaagaacctaaaaaatccccgttttgttttaacagcatcaagaccttatcttcaatatatttatgtgaataatttttagatttaatgatttgtttcaaagccttctcttttaatgcttcatcaagaactgcaggcttttctacctctgatttaactatactcgtataattacgaggaacatataaagaatctctcgaaacaaaactatttaaatatagattccccacatcacttacatctttaccactagcaattgctttaataatattattgatctttccttcaatatctttttgattgtttaataaaaaagtaattcgattgattgctgattcaataaatctattatttttactatcgatttcctgcattatttcttcaatatgttcaaaagcattaataatataatccttttgattcaacagcagctctaatgcctcctgatagccaagatccttacgttccataatattacggacaattatatcaagatacttatcatcactaataatagtttcaatgttattgataattcgctgccgatatttagaaggattatcataagtagtaagattataataagcgcgatcaacgatcttagtttgataatcttgtaacaatgagctcaataacgcctcgagatcatctttgatcccttcatccaacaaattttgaatatatttttttatattagaatttaagttttttaatttattagctagctcttttgtattttcataccctgtttcaaaaactagatcgccacgattaacatcaaaagtattgaacgacataaaaatattatagatcaaacccgaatattcaccattatcactactgctatcaagactaaatagattttctaagactctaatactataatcttcaaaagtaataaatatctcataattttcgcccgtttcctcattgacccagccacattcttttaacctttttaaaatatataaagctttatcacgtgaatcatctaacttttcatcactttttaaaaaggtaacatgattttcaaaataatcttgaaaaatcgatagaacttgttctttagtagacgaaaaagacaaatcacttttaaatgaatgataaactaaaaacaaacaatcagaaattacccgcttattatcgccaataaaaatattaaaaaagttattaggtaagatatcaaaaatattatacatcatctctatcctttctacaaaagtaaccttattataacatataattcatatttaaaaaaattttacattcgtttgatctcaataatttatcatgccattaaagtaaatcgccatatcatctttaaaaagtacccttttcgtattcaaatagcattttaattttatgactattttccatatcagactaagtctgatatatgcaaacaggtaaaaacgattatcgtttttacctgttaataatttaagagacatatattgtaataaatttacagtgagaaagtggctcgatcttaatagtattattttcaatatcaattttttcaagcttttcctcttttaaattagtataatacgcttctttaatatcgaaattaaaagatagcttatcacctacatctaaatgatctttcccattaaataaacgaattatataccccttatcatcttcactttttttaattgcacttattacaagcttattctctgtttcaaataatgatattgaagaagataaagtttgttcaacatcttcttgtgcaaaaatcaatcttccatttaagaaatcggcatactcataaacttcgattggcgtattatattcttttgccaactgatcgatattagcatcattgatatttgtagaaaaagtagtaaaccccagactgaaatccatttcctttaataattgtgcagccggtgtagcaatgatccgttctcctgatgctcttcctggacgataaactagattttctttccccataaaaccatatgttctaaataaagttaatctaatttgatttcctctttcaccaatgatttcatattcacggacgccctgaggaataagcgcgattcctctattttcatcagcaagactcacgtaactttgagttggttcaattgaaattggcggttcttgccatgaagactgatcattggcccaattggctaattcgataattttaggtttttcaattttttctttatttcctaatccttctagatacaaagccatttcttttgcatattcatttggccgcttaattgatccaaactgttgatcagcataattaaatttagtcgttaaagcactatcaaaaagaatgcataagcgatgtgataaaccatgattatctacatgaacattaatatcgattacttttgcgcctttttgtaatcctacctctaaacttactggtaactttgtacttacttttccttcagcccgctcttgtaaattagcaggaataatcatttcataattaataagtgctttttgatataaactagaaccaataatattattagtaaatcgactatcagttgaatatacttcgaaatcctgacgtggtggagaataattgaaactatcaccatcatcaccattttctaccagaatcgcttgatttaaataatggaaatcagctattttatcatagatatctaaactacctttttcattaactttgatttgataatattcattttccatgatatctatttttgaaacagtgtcattagaacaatcatctaagtcaattgtatattgaacatatcctaaagctgggacatcatttgctgcaacagcaatcttagcacgataaactttagctggcagataaatttctttactaggattcaatctaatcgtttgtgataaaacataatcggttaaatctgtttgttcaataatcgtatatttaataagatttccaaaattatctttaattgcaaatttgtcacctggtaaataggtttcaaatacgattgtatcattacgttttttaggtaaagtattaaataacgtaagtgtaattgtattatttgtttcatttttaattttagttgccattaaacgtgaatgtaattcaactaaattaacagcaatatcccgagcttgtttatagcgcatataaacatcttcattagccgtatctgaaatacaagaaccaattgaatcatgagctgcattttcaaataataatttccaaatttcaccaaccgcctcatgaggataatcgttgcccaaatgatacgataatgttaatagcggctctaaaatatttgttacataattttgtacttgggtatttagtacttttaaatcacttcgtgatgaaaaaatcgatttatgaattcgcatatgtttagcgattaccagctcgccactaacttcttctagatcaggagcttcatttttgacatccttgatataatcttcaacacagctgatcacatattcattatcaggatctttttggtttctttctttaattagttcaggtaaatttttacgcaccggcgcttgatcaaaaccattagggaagtaaatatgtttcgtggcacttctaccacccgctttttcaaaacattctttttgccaaaattcttcactatctttatcatcttcaggaatatttcccccaatataataaccaaatggaatttgcgttgcaaagactacactgccatcatcaccgcgccaattatagtcagtatgtttgaccatatcatcactgacaccacgccaaaataatgtatcttcgattccaaattgacgataaatttggggcatatttccagcttgtccaaatgaatcaggcacatagccaacattcatataaccaccaaaagtttcacagcgtttcatcccataatacatatttctaacgatactttcaccagaaattactagctgatcggtttgcgtataccatggcccaataattaattttttagccttaactaatttttcaattctttttttatcttgcggcatccatttaagataatcatctaataatgaaccttgcgcatcaagcataaaatatttaaaatcatcatttgtctctaaagtatctaaaacatcttttaaatctttcatcaaatatacttttgatcttgatgtcgtaaaataccattcccgatcccaatgtgaatgtgggatcacatgtacttttcttttcatactaactcctttataacaataggaagattttcatctccctattaaatttctatttctatttcaatatcatcttcagataactcatccacttcttcactactatcgttaaaatcaactactattggcgcaacgatggcaataaacagtgccccaacaataattccaacaagataagcccagccactagtaatcgaaacaaagccatacataccacctactggcggaatattggcagtggcaccaagtaagcaggcaattcccgcaccgagggcaccaccaatcatattgattggtactaagcgactagcttttacaagcgtgaaaggaatcgctccttcagtaatcccaataaagcccattacccagttacctttcccagcttcttgaaaacttggtgaaaaacgttttttcttaattacagtagcaattgcataagctaaaggtggaatacagatggcacaattaatataaacatttggctgataaattccttctgtcattaaaacatttcccgccatccatgcagatttattgattggtccacccatatctgaagcaatcatggctcctaaaaccaaagataaaactaattggcttgttccactattgcacatctcttttaaccaagatactaaagcatcattgataaatgctagcggctcagctaagacaactcccataatgattgcaaccgcaccagtcgctaaaaaaggagtaataactagaggcatcatttgttgcattgaatctggtaaatgaatatgttctttacaccatttaaccacatatccagcaataaaggctgcaacgactgctcctaaaaatccagctttagtattagttgctaaagccccaccaatcaaaccagctccgattgctggtttatcaccgattgaaaaagctataaagccacctaaaacagtattaactaaaccaattccggtccatcctacttgttctaataaatataaaatatgtaaaaatccctctttatcagcatagacatctaaactattgattcccatggcaaccccaatcaactttggaattgccacgattaatgatgcgccaatgatcaacggcagcatataaccaattccggtcattaaatgacctttagcatctttaaaaaacttcttcatcttttttacctctctttttatttgtgttataatgagagtgcacactactcattatagtcttgtgtaagcaatttgactccgccaagttaaattgcttttattttttactttcaactgctttaacacatttttttattactgcttcaggggctttgatacatgttgtaatgttaacacgaattacaggttttccctcaaaacgttccatcccgataattttttgatcagaagcaatgattacaaaatcacattctttagcttcctcatcactaatcgtgttgatctgccccatacttccctgttgttccatttttaaattataccctaattttgcgcctgctttttctaaagctttagcagccataggtgtatgtgctagtcctgctggacatgctgaaatacctacgattttcatttaatctacctccatattttttaatatataatcttttagctcttttttatcagtcactgattttaacgtttctttaaaatcatcttctaataaacaagttgctaatttagatatcatcattaaatgaagatttccttcattttcttcaggaacgagtaacgaaaataaataatttactttcttatcatccatcgttccccattctaatgcttcattacagcgtaaatataagattgctgctgtttttacatgactgctgcgagcatgaggaattgcaaaaccatcttgtaaacctgtcggaaactctgtttcccttttttttaaatcttcaagtagtccctcactactatcacagatgtcattttcaattgctttatcagcaataaacttcagcatttgttctttagttttagcattaacatctaaatatatataattttctttaagcatcacaccgatacctccttgctacaactccagtctacctggaaaaacgtgatatttcaaccaaagccatttccagttataagcggaaagatttgtttaataaacccaaaaatttccattttatattggaaattaattatttgcataaacaaacaattatctatacaatatagacagaataaggaaggaatcgtgataataatgtttccatacaaacgactaaacgaaatatttgattatgttaaacaagataatatcgtctccgtaaaacaattatcttcactattaaacataactgatcgtactatccgcagtgatattcaggcaataaatgatgttcttgaaaaaaatggggcgcaaataaaattaaaaagaaaagctggatattatcttgaaattaatgattcaaaaaaatatcaagagtttttaaataccataaaacagacaaataatcttgaacttgacacttctcaagatcgaatcaaatatttgttgaatcttttattatatagtgatgaatatatgacgcttgatgatctagctgatcatatttatgtaagtaaaaatactttacaaaactatatcaagagtttaaaaaatatctttttgaaatatgatcttgaatatatttcaaaaacaaatattggtgttaaagtaattggtaatgaagatgataaacgaaagtgtttagttgaaaatgtattatcgtataattttcaaaattatgttactggatttactaaagatgagtatgcgttatttgagggaatcgatcttgacctgcttaaacaaatcgtttctgataaattaaaacgtgctaatataaaaactagtgattttaattttaaaaatctagtgattcattttgctttaatgatttctcgaatccaatatgactgctatatcaatattaataatacgatcaaaattgatgaaaattatgctagttttattaatgatatctctactgaaatcgaaaataattttaatattactattagtgaaggtgaaaagaaatatatatactcacacttagtcgctaatagtcaattagatgatttagctgctaatgacagtcgcatcaaaactttggttaaagaattattggataatatttatttagattataattttgatttacgtaatgatgaaatcttattaaaagacctcttcttccactttaaatcaattttaaatactaagtcgtttgccctaaataagcgcaatcccttattaaacacaattaaaaccaattttcccttagcttttgatatcacactaacctgcacatctaaaatatttaacagcccaccgtatattttaacagatgatgaagttggttatatttcattacatattggagctgctattgaacgctgtttctctggcagtcttcaaaataaaagtgtgattttagtctgtggttcgggtcaggcaacaacaaggatgttagaggcgagattaaatgttttctttaaggataaaattacgatcgttcataaagcttcgtataatgaatttattaattatacgaaaagagaattaatgaatattgattttgttatttcgacgattcctttaaaaagtgctttcattccaactataaccgttgattttgcattgaataatcaggatatcgaagctatttctaaatttattacttctatttctttaaacaaatcaaaaaagtcaaataaattttttgataaaaatttatttattcatttagataaaatagactctaaagaagctttactaaaacaaatgtgccagttaatggaaaagcaaaatatcgttgacagcgactattatgattgtgtcatggaaagagaaaatctagcaaaaacaaacatgaatgaagttttcgctttacctcacccaatgcgtctatgtgctaaggatactaaggttgcagtagctatcattgacaaaccacttacctggtatcagcaggatactgttcaaatcgtctttttacttgcaataaaacaaggtgaccaacaagacattgagcacctttatgatatttttattgaaattgttaataatactaagttgcagcaaagtatcattcatagctatgactatgactcatttattaataatctattagaaaatatgatctaactattctttgaccattttgataaaacaccttttcttatcaaaagctattccataacctacgacatcctgatatcctcgaatcttttccccttccaaatatcgcttttcaataatctgattacatccttcaactgctgtatcatacaggtctttatctttaactatttttagttctaagataaagcctcttttttctttatttacaggtcgtccatcaccagtttcaaaattcgaataaatattattttcaggtaatctaaaataactaggggttttagattacctttttaaaaaagcatgatatatttgacgttttatccatcaatttatcatgcttttattcatttagttgtatatatttttcttttaagaactatttctatcaatctacaattttattttacagctctaaaatctataaaagttatttttcaacccatttcacatcagcatctttaccacaatgagctaatcctatatagattatctttccttctaatcctttatcatattctttttcaacaatctgttcaatcgttacatctgataaactttctaattcttctttatttttactatacttgaattcaattacatatgatggtaaatcctttttggcttttaaaataatatcacatctccctgattcggcttctcgattactgattatttcatactctcttgtcaaccaggcactcatccctaataacatcatatgataactgttttcatcttttaaatcatgatatgatggtattctttttaaaatatttcgataactattttcaaataattttttgtctctcgtttccaaggcataaaataaatcatctaaaacactttctgatacttgtaaatgataggctgtcagtgacataaattcctgttgtacttcttcattcggaactctgattcgatatctattttttcgcatcctctgctctactgttaaatacccggcatttacaaacaacccccatagactcgctgtttgtgactgttcataaaaactggtctctatcattatttgggtttctaaatatccctgtttgattaatatttcataaccttctttaaagctttcttcactttcgaccattgcttttttgatcatcacattactgctggtatttacccaatatggaactagcttttttctagaagcataattaatgattgaccagggattgtatatttctactccaccaatatgataaccatcatacatttcttttacttcatcatttaatagtaaatcataatattttaatagttcttctgtttctctttcagtaaaaccaaaatattggtcatatcgttcatccattactgtacacactataagattgtttagatcactgaagatattttctttggctactctctgaattcctgtaagcattgcatactgaaggcttggtgatagttttaaagcattatgaagcaatcctgctaacccgccttttatttcatcataaccttacattcctttccgcctgcgtctccaaggcacacatagtcatgaataaagtcttgtttgtgcaggcattttattttatatttttactgaaggagtcttacactacaaagcacggggaggtgagttgtagatttctgcaactcgttcagttcaaaacagtatcataaccagtgcagggctgaacttttcaagcacacatgagtatgtcttttgagtctgtagattaatcattgacttgagttaatcttttagtgttgttcagtcagtcactgagctccttctctatattctgaaaggagctttttatttatggaaatcgtttaccctagagcctgtggcgttgatgtgcataagtctttcattgttgctgttatctgcatctctgaatccgtcaaacccaggtatattaaaaaaagattctcaaccttcaataaccaactcattcagtttagacaatggcttatcgataacaactgtcaaaatgtatgcatggaatccactggtaaatactatgtccctgtatacaatgcattggaggaccacatctccaatgtcgttgttgccaatcctaaatgggtcaaggctatcaaaggtgagaaagatgacaacaaggatgccaaatggatcgctgatctctttaaattcggtatcgtcagatctagctatatccctgaaaagaatatccgtatcctcagggaatttactcgctatcagttcaagcttgtcaatatccgttcttctgagaagaatcgtttccaaaatgccctgactgttggaaactgtaagattgatcttgttttttctgatgtctttggtaaatccgcttcctctattgtcgatactattttatcagatgaaccctataccagtgaagacattctttctaaagttcatgtgttattcggtggattattttaattaaaataacagctatttagtcaaacaaaaataataaacatagaaaaatagttaaaataatttgataaaatgataggcaaattattttaactattttattattatataaaggagctgacatacaaaaaaagaaagggtcattggatcgcggttcttactcgcttatgggtaaatgaacttattagacagcacaagaaattgtgctgtttttgtgttctaaaatatcaattagcttaaaatctttattattcattaaaaatggtatgtaacatttcctaaaaagattgactattttacttcttccatataaaatacgtttgatgagtttgaatttgttgttgtttccttcaacaaatcccgaactatatggataagatattgcgttcttgatcggggcaatatctttttctataccttctataaatccttttaatactgattctctataattatcaataaacttatctagctgatcagtatctgcctccttgatcgtgctgtaaaacgaatcatatattttttctagttcagttataattggatatctttccttgattatttgaatgtttttttcaactgttttatttttctttgttttctcatttttagttgttatgtattttaatatttcatttctttttatgatgatgatattatctggatatttatacttaatataccaccccattgaaagagaaatactaaaattattttttaataagtatacaattctgttatccaatgacttccacgtacctttatatcctttcataatgacatagctaaagattatttctggctttattccatccaggatcattttatagatcatattgatatagtcatctgtagctgtttttctttgtttgtatttctttggactgtctaacaattgaatatcctcttcactcatatttacatattttttagctacaatatttgatattgaaaattctttagctattgttgtgtatttctttttttcgagttcctcccatcttttttgaatgtcaatgatcattttctgttttttttacggctttcagcctgctgtctgtgttgtttatcgtttttatcataacataccgcatcaaaatcaatcatatttccttctttatcaactggcatactgttgtcatagtcatatttttcaagttcctttgaatttggatcgatttttaatgctggaaccttttgaggttcctcttccagtacctttccatcttttatgaatactgtttccggtatttccgttttaaaaatatcttttattctgtcaattaaattttgaagaagatgaaatctgtctgcaatctggatacattcaggtaaaacttcactgattgcagaagcgtatgcacttgctctgtcacgtgtggcaatctttattttttgatgattttttagccattcaacaactgtttccttatctcttccatctaaaagcgcaataagatgatgatcttccatatcatatatggcagttgcataagcctttccttttctcatcgccacatcatctattccaatagactcgacatcagggtcatcttcaataatgatcttatcagtcaggcgtttgatagagtcattgcttatattgaccccaagaagtttcagtactttactggcaccttcattgcttaaaaagagagaaactgcaaggataagacagttaagctcatctgttcttctttgagagggagaaacaaaaggaagattctgcataataacctttctattgcatttgtcattagtacagtcatatttataagcaatcacatcaataaaagttgttttatttctaacaggataagcctgaatcattctatgataggtattatgtaaagaacttgtaggagaaccacatacaggacatacatcatcatgagaagtcgctttcacatatattatgattttattatctgattctttccagtcatagacaatgaagtcattaccaaagattttttcattcaaactgatttcattatatttcatatgtatcaccatccatacatatattgtatcaaaatgcccaaaaacaagaaatacaaactaaagaaaaacagcacaatttcttgtgctgtctaataagttcatttacccataagcgagtaagaacctggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcgctgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaatagtgaaaaaatagcctgttatatgaacagtattattgatggattgacgatagcaaaaggattaagtataataagcgctcatatagcacaataccaagcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacagttcatggcagatgtaaatcttctgatgaagatattctcagtgctgttgaaggcactgatttgaatcattatcagaagtcaagaatcagaatcgttcagaaacatatggaatatgttgattctcttcttgatgagattcagcatcatattaatataatggtctctgcctatgaaaactatatccagcttcttatgactattccaggtgtcagtagaaaatctgcaattatcatcatttcagaactgggtattgatgtatcacagtggtccagtcatcgtaagcttgccgcatgggctggactcgcacctggctgtaacgagtctgctggtaaaaagaaatcagttaagatttccaaggcaggtgtttatatcaaaccatgccttgtacaggttgcacacgctgctgtcaaagacaaaaattgtgattactatgcagacaaattcagcaggatttcaaaacgtcgtggcaaaaagcgtgccatcatagctattgccagaaaaatacttgtagccatctatcacattcttaaaacaggtgaggttttcaacccatctgatatggcagacgtagaaacaacaaaacaacagcgtatcgaatacatcaaaaacaatttaagaaatgctttcaatcagctcagccgcactggtttgagtgatgaagaaattctacaattcattatcaagaaatctagcaactcacctcagacagaatagccttccatttggggaaaggggctttatgcacttttttaggtaaaacattattttccgttcttattttttattcagattaaccacttacatgttcttcaataaatggcgtatcatattcatcgatgaacagcatgactttcttttgataatatttttctaactgttccattaaaaatgataaagcattggtaatacctgataaatcatgattatttatgagttcattaataattttttcataattaattgttttaaattttgacatatttgtaaatacgtattcataacgatcgtattcattttgtatctgtaatttaatacagttaactatttcctgtaaactgtttttagctcctgcaaaagtgataaaaatagttggatactggttgatgtaatcagcatattcagttttcatgatctttgtatctttaaataattctttggaatctttggtaatatcaaaaaaattagctaacattgacatatttaaagtcttgccaaatcttcttggtctcgtaattaatgtaacaccgcttttcctttcaagaaactctttgatcatcaatgttttatctactgcataataatcatcttttattaatttttcataatccattattccaagtggaattgcttttttcatttctatcaccctttttgcatatatacattataccttaatttaaaactattaactatatatactatatttttaaacaaaaagggacaaacgtcccaaattaagatgctttcaacattttaataaaagctcgttttttatcaaaagcaattccatagccaagcatatttagataccctctacccttatcactctctagatatcttttttcaattatttgattacatgcttctatagctgtatcatacaaatctttatttttgcatatttttaattccaagataaaacctcttttttctttattaaccggcaaatacttaatatcacttctgccatcaccactttcaatattagaaaacaaattattattatttaataatcctaaaataaaaccatgataaaaactttctttaccatcatggtaactcattgattgcagtaaaatataatttaatatctcatttgctttattttcatctttatctaataaggcatcaataagcttctgaccatagttttcttgaattttattggcccattcttgaaaaacatttgtatatattagtttaatttctttattaggaatcattaatctataacaatttatatcaacatatttaataattttaagataacctgtaaatagcagaaaactataaatattattaatatcatccatttctcgatatgttagctccggtttgattattttttcaatactttcaccattaattaataaatcaaattcgtcttttagtttttgattcccttcaatgatatatttatacacaatatcattgctgctggtattagcccaaaatggtatagcagcaatatttctatctcctaatagttcttttacatatagcaatgtgctccaaggattatatatttctttgtcatagaaacaataaccatcataccattccttgatatagccttttttatcataaagatcgtaatattttaataactcatcaatttcattctgttcaaaaccaaaacagtcacttgaatattgattaagtatagatctaacactaaaattatttaaccccgtaaaaatactttctttagctatttgtaaacatcctgtcaaaactcctctttctaaagaatcattggtttttaaagcagtactaaagatatttcttaaaaattccaccatttcatcataatatccattaatataagcactttgtaatggaacatcatattcatcaattaaaataattacattttgatgataatgcttttttaaacatttgctaataaaattcaaagcatcttgtaaatcaatttcattttttgtttctttttgatattttactaaattatctttatctatttcttctaagtaatcactatttaataattctaaattatcatttattaagtttctaacaatcttactaaatattgcaatttgatcattaaatcttttacttttcatatccttcaaagtaataaaaataacaggatactgattttgatgtttcataacttcaatatttttacttatttctaagttatcaaaaagataagcattttctttttgtttaattgaaaaaaagtaataaagcattgacatatttaaagttttaccaaatcttctaggtcttgtatacaaaataacttcttcatttattaaatcttcaattaatttgcttttatcaacataatatacatttttatcaattaactttttaaaattttctattcctatcggtaaccctttcatcaaattcaatctccctatctttaaaatatcattatccctaaagctatattaagattttgtatactaattattattagtataacatatttattggtaactaattgaaataaataatttaatctcataaaaataaagatttcattttattgatctttttaatatatgaactagcgttgattttaaactatttaactctaaaactccaactacattatacacatatatacatgtgctttgctactattttaaattttataacaaactaatttctaatataattttaaccttcatctttcagccaaattcctattgctgttattaaacatttaccaagatataattagtatttagtttgtttaatgttatcatacatcatgacagcttctagaattttatagactattacaggtttttaaactcacatagaaccctaggtttatctatagtactcttaattaaattgtatcatatttatttatctgtctatatacagatattttccacctatcataaaaagagaagcaacgcttctcattcaataaataaaatatccaaattaatgtgatatcgattcttaaatataaaatttcaaaattgaattgaatatatcataacgttaaaagaaaataaaaaattaactactgtacgcacaatataattctagcaaaattccatatggtaacaaaacccgcttgtcaataaaaatatttatttttttgtcttattctagcaaaattccatatggtaacaaaacttcttctagcgcctcctttagagttaggtggtcttattctagcaaaattccatatggtaacaaaacgtgcgtctaagaacaatcgcgcttctactggtcttattctagcaaaattccatatggtaacaaaacgagcattggaaagagtttaatggtgaaaatgtcttattctagcaaaattccatatggtaacaaaactcgtatgtggtctcgtaagactcgctttgagtcttattctagcaaaattccatatggtaacaaaacgtggatctgaatcattaaaatatataattagtcttattctagcaaaattccatatggtaacaaaacaataatagttatacaatttggggtgtcctcgtcttattctagcaaaattccatatggtaacaaaacgctagaaaatcctttatgtgttttagtgttgtcttattctagcaaaattccatatggtaacaaaacagcgacctttataagcatagctataaacaagtcttattctagcaaaattccatatggtaacaaaacgctggccatgtacaggatgtcggatggacagtcttattctagcaaaattccatatggtaacaaaactattactcataaacttttagatgagttttcgtcttattctagcaaaattccatatggtaacaaaactaatgctgtttctacttttaacgctggtgagtcttattctagcaaaattccatatggtaacaaaactcacgaaaccattcattccaaatcaatccagtcttattctagcaaaattccatatggtaacaaaacctcaaaacaaatattagcatagttttgaaaattaataaatatgaatttttacatatttagtaatctttttataaagctacatttatcactaccattattaataaaatattctttcatatattccttcacctcgtataaatagatcggtttataacagttattacaaatcatttcacatacttgttcttcattagcaaaatctattttaatattttccaacaacaggatattatctaaatcaatattttcaataaaatatttactatttacaaatacaagcaaaaaacaatttttcatacatgacaataaatttaaaatctcagggctaagataaggtatttctaaaataataaaaatataatcatatattttattattactaattatttcgtttataagttttaattgaataataatgacatcttcaaatgataaatcatattcatcacatttatagccatctatgtcaacatagggttcaattaattttgttaatttcttctctgtcatgacatcataattagttttaattacagaaatttcattaatttgctcacataatgtctctaaaagataattaatcgtatttattatatctatgagttctggtttattaatcataatttcaagatatttagcaacaagagaatttgtttgcattttaaaatctttataaagagaaaaattttcatttacattaaataatattgatctttttctattaactaatttatcattaacataaattgaaacttccttcccaaattcttcacgatattcattctttatattagtaaaaaacaacctaatatctctacaaagactatttctatataaatagttattcccaactataaatttatatttatctattactatattatttttatcatttcctctacaaatagttattttattcataatttgataaatgattcactatttatctttttttcttgatttgatttacctccaactattacttcaattttagaatattgtttttcagtgactaacattagtctaatttgcccttcttttggaactgttcttcttaacatttcaatatgttttacagcagcctcacgatttgcaaaaagtttacaataaacagaaaattgcatcataatataaccatttttaattaaatactttctaaatctattatatatttttatttcattttttgtgatcattggtaaatcaaacaaaagaattaatctcataaaattatatatcatataaatatggtagaggaaaaataaatgcttttggattacctgtttctaacacttttaacaatgcttctatatatacatatattgcattagcaatagtttgctgttgattacaaatttcaatttttttgtcactacatattctaattaaaccttctcgatgtttctgtttaaaaataatctcatctctcatattcaaatatacatattcatctattataggtctaaatacttcaataatatcatctgcaagattaaacatattttgctttccgcgatgaaaaataccaaaatttcccaaataccctttagcacaaatgatagaactaatcaaagatctgataatactataaccataatttaatcctgcgttaatgatatcttcattcattctaacaaaatcagatccaaataattctctaaaatacatttttgctgctaacccctctctatttgtctcatctcctaattgtatttcatttaaaaattgttctaacttaataactgtattataacctttatttaattttcttaatatttcaatttgattataaatttttgctctaataattaattggtgagctaacaacttattttcatctttccatgctatttgcttatttatatttccactttgcgcaaaattaccattcattggtaacaaataactttggggaagatgatccattccacaaaaaataacacatacattattttcagttaatttattcattaattgaatacttaaagtagctttataattatcaattactaatatctgaatatctgaaactggtatcaataattcatcatcactaattatgacttttaaattatcaagatataatctcaaacattcacttttttcaatatatattactctatgactcatataacaaaaaaaggctcttacgagccgattccgggataaacccttgttttgttaggtcatatgaaattttgctagaatatgactacagaaatgatagcacactacaattctaatttcaagtgattatttgtaactttataaagatttcctaatacatcagttgcatacttttctacttttacaaatgtgccaattgaaaacattaattgcttagaacaatgataatcaataggtttaacatctattttattttccttatcattattagtagctgtaaattttaaaatttccacattatttccatcatgctcgttttcatttcttggatcaatgtacttactaccttttttcttagcaataccaataagttcatcatggtgaaaactagcaataaatacagcttcatcactaatctgtttaatttctttttgttttttataccagttttcatcaatataataattgtttttagccttattaaattttatatcactatatcttactgtaaccatcttatatttacctttatctaaccaaatatcactacgataaggtgacaattgcaacaatacaacatttttttgattatcttgcttaacttgataattatctgtaatagaaacatgatttcctaaattttcactatcatattttattgaaacaacaattggcccatttccttttttagagtattttgtaataaaaccatgctcttctttatattctgttaaaggattttttcctttaagttcaatttctccttttttattcttactataatacttagtatcatttttaaacgtattataatgattcaatacaattgccttaattttttcaaacgtttgataatcatgtcgtttcattaaatatttatcatctttttcatttaaaatatcttcagttaaatgtctaaattttggatcataaatatctgaatacttctttattaatcgctcattttcctcgatagttctagtactgtagattgtatcatcggcaattttacgatttggttttgtatcaactttatgagaaaatttaataactttaacattcttcagattagaaatatattcaatatattttggatctaaatactttttatcgtcttctactttaataatttcacccgtatcactattgtacaaatcatctagatcatattttgataataacgtatttaacaaacctaatttttttatagatgcaacaatcaaagcgtctattgcatgatgtgaataatccaaatctctatctttatcaagtttgatacgttttctaaatgcatttgtcgcttgtcctttaaccgtatggaccttagttggaatttcgttatctctaaaataatctgtaagtgtattcaaaacaactctacatgcatatgatgtatctacaagattacgattaataaattcttttgcattactgtatttagttatatctttatcatataataaataatcttttttctttccataaaattgattatttgtatatacatatgctttatatttttctaaactacctttactaaatttaccttttaaaaaagctccaattggtgttaaattccctttttcttgattttctagataagttactaaaactttatttgctaaagaatcatccaaagaaattgataatggaattatatgatctatttcatatgcatttggatctctaataatcaaagataaatctaaatcattttgataatatgcacttttaccattttgttgcatatataatctgatttttgtttttgttttagcattaattttatcagggtcataattagcttccaataacaatttattaacttccttattctcttgctcaaatttctcttgtcttcttttaatattatttttttcttcttttgaattctttgcacgagtcatctcaattactatagaatctaattcaccataatcttttctaattttattaatcactttaaaagcttctctttgcgctcttttaactactggtgataaaattgcgttttcatcacattctatattttttcttcctttatatttaccaattttttgatgatagagtttattttgataaataatttgcatttgattcattgaagtttttagcatttcttcatttaattcacggagtgctttaaatgataatgaatgatacccagatattgtagtattattagctaaatcaattaacaactcatcagacaaattaatatttaaattttttaatctttcaattcgttcttcaataattttagtttcaactaaaattaaaataatctcatctaataatgttgtctccatcaataaatctgattttccagctttatcaaaaatcttttttaaaactttatatcctttaaattctgttaaaagtggctgctctttcgtattaatcctaaaaccactgattttatctaaagatactcctaattctttagcaagtcctttaactgtaatatttcctttttttaaaacaatattaattaaattttgcttttctttttctgttagtttttctccttcgatactaagattatttaaatcattcaaaaaattaaataattctgcactaaaactttgttttggagcccgatattcatcaggatataaactacatttaccacgcatttttttaattaaatcaatttcctgtaattgtccatactcatcatagaaaaagcgaccataaggtgtaggagatttcttgctacctggcccttcagagaaatgtctacgtcttccaatcaatgaaataattgcttttatcccatcttcatctatattttgatttgataaaatcttttcaacctctttaatataatcctttgttttaaaattattttttatgcctcttaatgatccttgctcatttaatctttttaattggactttacaaacatattcatctttttctaattctaaaaaattttgtgataatattgcctttgtccctttttcagtacttttactttcttcttcagcaacctctaaagaacttccccgatgctttgtaatatgcatcaaggcacatgtcaattcttggttagttaatttttcttcaagacctttacatctaatttcataagggttatttaattccttataatcactagaaaaaatatttaactcttctaataattttttcatatcagatagtctattttttctacgtgatattaaccttctagatcctcgtttatttcttctattttcattatcttcagcggttgcttctttaaataaccgcacaccataatcaataaaatcacttgtttctaaatcaatcaacccatatcctactgatgcaattccaatatcaattcctagtactaatttagccactttaaccctcctttaattttatacataaactatatgttctaattgtaaattagatcttctacaatatcaaatttatattctaaatatacatcacattttacatgtaataatcatttttataacaattatcttcaaacatcaactcttttctcacaaatgcattcactataagtgaatataagaagtttttttatccttgtataattaattaataaacaaggagttttaacatatgaaaaattatgatcatgaatataaaaaaataggtcttaacattaaaaaatatcgccttcaagcaaatttaactcaggaagaattatgcgaaaaagtgggtattagtattagttatttaagtaaaattgaagctccaaattgtaataagagtttttcattagatcttttatacagaatttgtgatgttttaacgattgatataaaaaaattatttgagtagtgaggttagagcatgaagatattttatgtatttcaaaatcaaagcaaaaaacaagaactaaatggaaaatatttatggtcaccgcaaaaaaaattaactggtgaaaatgacttaggttatataaatatgtctaaagttcaaaaaggcgatttgatttttcatggtgctaatcaagaaacttttgctattagtattgctcaaagcgactgctatgaagctaaacaacctgaagaattaaaaaaattaaaatctcaacaaatctggaataataaaggttatatggtagattgtgattataatttacttacaccacctcttgatatgagacaacatcgagagtggttaaaagaacatcaattaaaaggtggcccttttaactcaaacggtagtggtaatcaaagatatttatcacaaatagatctggaacacgctaaatatcttcttactaaaataaaagaaactgaaaaatttaataaaaccaaggcttttattcatgctttattaacagaagcaattgaatcagatttagattatgatcatgaagaattagatgaaataaattcatcattagatgattttaaaaatgaaagttttattgaatctgaaaaaccagaaaatattgaattaacaatttcaaataatactggaattcctagacctaaaagaaataataacaaagctaaaaatgctttaaaaaaagcaaattttaaatgtgaaaatgacatatcccataaactatttttacgaaaagatggaaaatatgaatatacagaaccgcatcatcttatccctctttcaaaatacaaagaatttgaatatagcttagatgttacagctaatattgtttcattatgtagtcactgtcataatctattacattatggtcgtttagaagataaaatgattattttagaaaaattatataacgaaagaaaagacttattatctaaaaaaggaatatctatatcatttgaacaattacttgattattacaagtaattgttcttttctttaaataactagttaaaattgttataataagcaaacaggagtgtgaattatatggatactataaaagtagtagcggcaattataaaaaaagaaaataaaatattaatcgctaaaagaaaaaatggtgcttttgctggaatgtatgaatttcccggtggtaaaatcaaatttggcgaaactgataaacaagctttaatcagagaaattcaagaagaattagagacaacaataagtgtcgataaatattttatgaatgtaaattataaatatccaaactttatattagatatgaattgttatttatgctcattaaaagataatcatattaaattaaatgatcatacttctataaaatggattacattaaatgaacaaaatattaattggattcctgctgatatccaaataataaaaaaactacaagaacgaggaatttaataatgacttcaactttacaatctaatccaaaattacatacatataacccccaacccaagctactacttaacaactacaaacaaggtatcaaagtatcacacgaattaataactcaattaaatgcatgtgaggcattttacttttctgtcgcttttatcaacaaatcaggattagccgtcttaaaacaaactttaatagatttaaaagataaaggaattagaggtaaaatcattacctcaacatatttaggttttaatcaccctaatgtatttaaagaattactaatatttgataatattgaagttcgcatttatgaagatgaacaaataggctttcaccctaaaggctatatctttaaaaataataacaattataaaatcattattggtagttccaacttgacccagtcagctttagctacaaaccaagaatggaatattatgattgatgctaatagtggtaacgattttgttgaagaaataaataatgaatttaaattgcagtggcaacattctgttcctttaactaaagaatggatagaagaatatgaaaaaacatatattcctaaatcaatccccattaatcataaacaccaaaacattcagcctaatttgatgcaacaagaagcgcttatttcattgaacgctttaaaaagccaaaaaaaagataaagcattgctgatttccgcaactggtacaggcaaaacttatttaagtgcctttgctgtaaaaaatgctgatcctaaaagaatgctttttgtcgttcaccgtgaaaacattgttcatgaggccatgaacacatataaaaatattattaaaaatcatacttttggcctttttactggtaatgataaagatataaacagcgattatatctttgcaacgatccaaactattcataagcaaaaatatcgagagttatttaaaccagatacattcgattatattattatcgatgaagttcatcgagctggtgctacttcatatcaagaattgattgattattttaaaccgcaatttttattaggaatgtcagctacgccggaaagatctgatcattttgatatttataaaatgtttgattataatatcgcatatgaaattcgtttacagcaggcaatggaatatgatttattgtgtccttttcattattatggaatatctgatattgctgttgatgggataagtatcgatgataaaacatcatttaataatctcgttactgaagttcgggtcaaccatatcattgataaaattgaattatatggctattctggaaataaagcacgtggcttgattttttgtagtcataaagatgaagcaatagagttatcgaatttatttaatcaaaaaggctatcatacagttgctttaactagtgatgatagtgaaataaagcgccaaaatgccattgataaattagaaaatgatcatttagattatatctttacagtcgatatctttaatgaaggaatcgatattcctaaaataaaccaaatcatcatgttacgtcctacccaatcagcaattatctttgttcaacaactaggccgcggcttacgtaaaaatgcttctaaagattatgttgtcgttattgattttattggtaattatgaaaagaattttttgattccgattgctttaagtggcaattatacttatgacaaagatagtctaaggagatttgtaagtgaaggtagtttattattgcctggggcttcaacgattgactttgatttaatttctaaaaagaaaatttatgaagctatcaatcaagctaaatttaatgatctaaaaataatcaaagacagttatcagcagttaaaggataaattaggaagaattcctaatttatcagattttgataaatatgattcaatcgatcccttaagaatctttcaaaacaaaagtcttggatcctatcataaatttctaagcaaatatgaaaaagaatatccgatcaaatttacaagactgcaagaaaaatatcttgaatatatttccaacaaattggcagctggtaaacgaattcatgaactattagctgttaagctctgtatcgaaaataaaaacaatatcatcacactattaaaaaaacagctgtgccatgattataatattgaatttaaagaagtaaattatctacctattatcaaccagttaaaacaagaatttgccaccggtggagctaaagctacttttcaagatgcaatttttattgacgatgatttaaatgttcatccgcaattaaaaaatttattaaaagacaaagattttaaaaatcaattgcttgaagtaattgattttggtatcagccgttatcaacgatattacaatgatcgatataaaaatactgatttatgcctatatcaaaaatacacttatgaagatgtctgtcgtttattaaactgggaagtaaatgctgttcctcttaatattggcggctacaaatatgatcagcggactaacacgatgccagttttcatcaatcatgatcatgatgccattcatggcggtaaatatttacatcgatttattgataacagcactctgatttgtttttctaaaccaaatcgaagcatagattctgatgaaatccaaagaatttatgatgaagataataaccatatccaaatacatttatttgtaagaaagaacaaaaatgatactacttccaaagaattttattatatgggacgattacatgcgatagatggacctatcaatgtaaaactccctgacaataaaaattcggccatccagtttacatataaattagaaactccgatcaaagatgctttatttagctatcttacaagcaaaacttgatcatttaaattcatctttttacaatactttacttaaaaactggtataataacttcgaggtgattaattaatgaaagaatgggatttaagtaaattatatacatcatttaatgatccaaattttattaatgattttaataaaatcattacgattcaagatcaaatcaatacttatcgtaatcatcatgatgttaaagccctagaaaattatctaaaagacactataacgatcaatgaaatgattgaaaaattagctaatttcatcagtcttactttatcagttgataccactaataaagatgccttaaaatatagtgatcaattagacactctactagcgtcatttgtcgaagacgacactttaaatcaacaatggatcgcttcttttgctttagatacccttgattctaaactgatcaaagaacatctatttattctaaaagaaatccaacaaaaccaaaaatatactttagataaaaaaagcgaaagtatcattgcccatatgcaaaatactggaagtaacgcttttagtaaattaaaagaccagcttatttcttcaattgaagtcaatattgataatcaaaaataccctttaactgaagttttaaatatggcttatagcaaagataaagaaactaggaaaaaagcttatgaatcagaaatcaacagctatcaagataaagaacaagctatcgctgcttgtttaaacggaatcaaaggtgaagttttatacacgactaagctgcgggggtataaaaatgaattagaacggacgttgatcaatgcccgaatgtcaaaagaaacgctagatgttttacttgaaacaataaatgaaaatcttcctctttttagagattatttaaaaatcaaagcaaaccacttaggctatcaaaacggtctaccatggtacgatctatatgcacctgtagttgaagataatatcagctatccctatgaaacaagctgtgaattcatcattaaacaattcaatactttttcttgtcatctaggtgattttgctttccaggcaatcaataataactggatcgacgtttaccctcatagcggtaaagtaggtggcgctttttgttgtaatttgcatagtctcaaagaaagccgttttcttttaaactatggtaataacttcgctgatgcaattacgatggctcatgaattaggacatggttttcatggtgaatgtttaaataatgaatcgattttaaatagcgcatatccgatgccaattgcggaaacagcatctactttttgcgaaacgatcgtaaccaaagccgctttaaaagatgccgatgataaaactaaactagttttattagaagatgaattatctggtgctactcaagtaatcgttgatatttattcaagatttttatttgaaagccgcttttttgaaaagagagaaaatggtgctctagccgtcgctgaaatcaaagaattaatgactcaatcacaaattgatgcttatggtgatggtctagatcataattatcttcatccatatatgtggacttggaaaccgcattactattatgccgattgctctttttataattttccctatgcttttggacttttactagctaagggattatatgcaaaatatcaaaaagaaggtccagcatttagtaatacttatgaaaagttattatctttaactggtaaaatgtcattagaagatgtttgtttaagtgttgatattgatttgaaagataaagctttttggcaaagttctattgatacttttaaagaagatcttgaattgtatcaaaaattattaaaagctgttaaaacagtctaaactgtttaacagctttttatttaaataacactaaatagacatccatttcgttaacagctaaaaactgcttgatcgtatctttggcaatatctaaagcttcctgatatggatagccataaattcctgatgaaatcaaaggaaaagcaattgaatgacaattatactgcttggctaaaagtaacgaattttcataactgctagctaacaattctgcttcatgatgtttgccatcctggtaaacaggaccaactgcatgaataatatatttagcctttaaatcataaccattagtaattaccgcctgccctggtggacaatattttttcaaattacattctgcttgtaatttagtagctccagcccgtttaaaaatagcaccacaaacaccgccacccatcttcaaaccagaatttgctgcattaacgatcgcatcagttgccatcaaagtaacatcaccataaataatttttaatcccataattcaaacttcctttttatttccgctaatattttttaaaacttaactttgaatttactactatctaaattttactaaatattatctaatattaaaacatcttatctataatttttactattaacatgttaaaatatgatagaggagaaacgtatgtctaataaaattctaacaactgaaatccaaaatgtagttgaaaatcaaatcaaaatgaaaaaaccccaatgcaccaatgaagcatacataaggcttcaacaagaaggatgcagtaagcaggaagctaaacatttaattggcaaggttttagaaaaacatattcgaaatatgatcatgtatcaaactacatttaacgaaacttcttatgctaacgacttagctaaactctcaaaaacaaatacaattactacaactgaactcatttaccaaggatatgactattttcacgatgataactttgatcaatgtcttaaactgtggtcatcagcatggcatgaaataaaaacagctattaagcaaagcaatcaactcaaagttactcttgaatggttagaaatcctgctcgattatgaagatacaataaaaagctggtttgatgattttttaacagctctatgcaacaatcatgacattttacagcaaaaagaatttttgaatgaggtactaactttatttacttgcaataatcatgaattagaccatttcaaaactgcctatggtgaatgtttagtgtttttaaaagaagatgatcaagcttataaatggtataataattggcttgaagaagatggctctaattatacttgtcttgaatcttacctatctagcttgattcatcaaaataaactcgattttgctaaggaattaatagataaatatatcgatccagaaatcgaatgtgattttgatacattatcactattttgcactttaacattatattatactttaactaaagataataaaactcatgatctatatcaaaataaaatagatacatttcataattctttttttaaaaaagatcaccattcaacaaaacaacatgtaaaaaaacaagcaagaaaaaagattcgtcataaatctaaacgtaaaaaataaagacatcatatttataaattggagaaacacaaatgaaacttaaagaacttggaactattgtccgcaaagaatttatttacaactgttattgtaatattgtaacagaacctaaagaatataaaaaaatcacacgtaataaaatgtttgatgaaatcatcaaaacttacagtaatatcaaaaacattcaagatattttaacttataaagaagtaatatttttaaaaaaagctttaaaaaacaatcaaattgaagctggtcatgacaatatcagtcgtgaattatatacaaaaatgcttctgcttcctaactttaatactatcgatgatatcctttatattcctgaagaattaagcgaatatattcttgaagccataaaaacacttgatttacaaaaaataaaaagaaaaagtgaattagatgaaataattaaaggcatgatcatggcttacggtatcatgaacatcgatacttttattgaaatactgttaaaatattatcctgataaaaactatgatgaactatatgactatctaattaccgcaaaaagtcttaaacacattattgacattgatgatgatataattcaaaattacgactatcttggagaaaatatcggtaatgaaattcttgatcttcaagaagaatatccaatctttgaatataagatattttctaaaaatacccttcgcctcatcgctggtgacaagtatgatcatcgaagttatacagattttacgaacttcttgactgcaaatctgatgacttatgaaagtgaatttatcattactaattttcgaaattgtgttaacaccgtttgtgatccagagtcattttgtgaatggttagaggaaactttttaccagaaagattttgatcttgatgaactttgtgatttattcactgaagcttatttcaattatccctgtgctgttttatacggccacccaatttccgatttaacagattattttgaaaatgatgacgctgcttatccccctgtaattcaaagcaatgctcgcatgtgtgaagatgatgtcaaaacatttttcaaaatatatctaggtttattggaatatgccaataaaaaattacgtgtaacaaatctaaaaaaaatctatcgaaaaaaagacttgccatctgaaaaattaactaagattcgtgatgctttatttaaaaaccatcgtaatatcattgatgattttatcaaagataatccttttaattttaatgatgatgaattaaaaattcttgataattttaaatttggaatcatcgatcaatttattattgttgaacatcgtcaagattgtacgatagtttgtacaaaaaataatgttagttataaaataaaaggcctttattccaacattggagaaattattcctgctccagcattaacagaaatgctgatcttaccatttagaaatgtgattacttatgatggattgatcagtgcgtatccgatttcaatgggaccaggaatgatcaaaatgatcaatgagctcagtaaaacagaggctcttgaacaaataaaaccaattttattatcttaataaggagttagaaaaatgaatgctatagatgtattaagagatcataaaaattttactgttatcggtgcaaccaacaaccaagaaaaatatggttataaaatatttcaatgtttaaaagatcttggtaagaatgtttatggaatttcacctgtttatagggatattgaaggaacccctacttatcctgatttatcagccgtcaaaaataaaatagatgttgctgtatttgtcgttagtccaaaatttggtgttgattatgttaaagaatgtcaaaaattaaaaattgagcatatttggctacaaccaggaacttataatgatgaactgatttcaatgatcaaagaggcaaaaatcaattattacctaaattgtgttttagtagaaagtcaaaatatctaaatagaatcctaactatagtttacataaaatcaaatatgtgcgtctataatatatttaggaggtcaaaaaatgagaacattatattataatggcgatattttaacgatggaaaacagcagttatgaggctatctatgttgaagatggaattataaaaaaatgtggtgatcttgtcactttaaaacaagttattcctaatgatacaaaattaatcgatttaaacaataattgtctaatgccctcttttattgatagtcatagtcatcttgtatctttagctaaaacattaaacttagttgatttgagtaatagtaccagtattaaagaaataatttctcgttttaatcaatatatcaagataactaatccagaaaaaaataaattgttagtgggatttggctatgatcataattctttaaaagaatctcgtcatcctttagctaaagatcttgatcaaatagcttatccagtaatgatttctcatgtatctggacacatgggagttataaatacaaaagctatgaagttatttaaaatagataatagtgttagtgatcctgctgggggaaaatatggacgtgatgaaaaccagcaattaaatggttatcttgaagaacaggcttatcttatgattgcttcaaaaaatgatgaaacaaatacaaatttaaaagaacaatgtctcgaagccttaaaaatttatgccagttatggtataacgactgttcaggaaggttatatgaaagaagaagaattttctttattagcttcattagcaaaagaaaataagttatttttagatgttgttggttatgttgatattaaagatcatcagcaattgtatcaagaaaatactttatatcatcaatatcaaaatcattttaaattaggtggttataaacttttcctcgacggttctcctcaggggaaaacagcctggttaagtcagccatatttagacagtggtgattattgcggctatcctatttatcaagatgaggatgttattaaatatgtagattatattttacaaaacaatgttcaattaataacccattgtaatggtgatagggccgctaaacagcttttagatgcttttaaaaatagacctactaatactcgccccgtcatgattcattgccagactttacgtcccgatcaactaccgcaattaaaaacgatcaacatgattcctagtttttttgtcaatcatctttatcattggggtgatattcatttaaaaaatcttggtccgcgagctcaccagatttcttgtattcacagtgctttaaaacaagaacttccatatacttttcatcaagatagtccagtaattccccctaatatgcttgaaagtgtctggtgtgcttgtaaacgagaaactaaagcgggaattattttaggtgaaaatgaacaaatctcaagatacaatgctttaaagggcgttacgataaatgcggcttatcaatattttgaagaaaaagtcaaaggttctattgctgagggtaaaattgctgatttaattattttagataagaatccctgcaaggtagctatagatgaaattttaaaaatcaatattttaaaaaccattaaagatggacttgttgtttattctaaggatattcagtaacagaatcccgaattgcaagcagagagtggaaataagataaaaaagttctaatttttatagaaaatcgtatttttagttataccaattttagccagttctttgacaaatagctgttctgcaggaagataaccaagtatcttccttttcttttgattgattttttgattaatatctaatgttttttctttatctattgtattaatatcagttcctttctttataaaatatcttataagtccattgcagttttcatttgatgccctatcacatgaatgatatggtctcccaaaataaatctttgtacgctgttcttttgatcctggtttcttttccatatccttccatctggcaaattcatttccattatcgaatgtaatggatctgaatattttcttaaaatcgtcaccataaaatttatgaagcttattgatctgcatataaacttttttagaagattttgatgtaataggaatcatataataaaatcttgtttttctttcaatcagggtcaaataggcaccattttgtccatctcttggaccagtgacaagatcaccttcccagtgaccaaattcctctcttgtatcaacgctttcaggtctttccatgatagaagttcccttctgtcttttagggatataagttttccagttctttttcgtctttcttcttagcattctaggcagatcaattggttttatcgaaacttttccttcgtgtatgtaattatagaaagtcttagtagaaacagttaccatatttttaattttatctttttcatgaaggcgaagataattgatagtctcatcaacagaggaaagtctatttgatttcatttcattttcaacgagagtgataaaatcatgagccttatgaagtttagaattgttaggggtcttatggatcttagatcttttttcaaaggcagccaaagcagaaagttcagtacgttcattaagataggtatctctaacagtgatagtggcatccttaatgatagaatagacattagagacagaagtaccaacagaaacagccaaataatgaatgaattgagttttaccgatattacgcttatgaccagaatgcagagcgttaaaacgaataagttcattaacaataaattcataatgaaaaaactgaaggtgtttatttttagatttttgtgatatagtataagtgttcatagagagtctcctttattaggttttggtcgactaaaataatacgacttctatgaacatttttcatgtaaaaaattaaaaattgagactagagggagttggcggcgaaatgtaatgattggctagccaatcattacattaccttaattccagtttcattttacaatacacattcagtaacagaatatccttttatcttgacaaatattatcttcattgttaaaatcattttagttctaaatagaactatttggaggtattatgatcattgatttcttagatactattacaacaataaaaaaactatatacagtttcattagaacctgtatgtaaacaatatgacctaaccagaatggaactagatattcttctatttcttgctaacaatcctcaatatgatagtgctaaagatattatcgaacgtcgtaaattaacaaaatcccatgtttctacctcaatcaagtccctaactaaaaataattatctcaaacccgtatatttaccaaataataaaaaaactgtacatttaaagttattaaatagtgccgatgaaatcatcaaagctggtcaacaagcacaaaaaaatttttttgaaacgattcttaaagatttttcaaaagatgaaaaacaaacaattattaatgctttttctaaaatccaaagaaatgctcaacaaaaattaaaggaggactaatacatgttatataaatttattatttgttttctcgctggaatcggagccggactaggaaccggttttgctggtatgagtgctgctgcagtaattagtcccatgttgataacttttttaaatattccagcttatcaagcagttggaattgctcttgccagtgatgtcttagctagtgctgttagcgcttatacttatggtaaaaataaaaatcttgatattaaaaacggaatcgtaatgatgattgctgttttaggttttacaatggtcggtagctggatctcaagttttctttccagcagcacaatgggcggtttctcggtttttatgactttgatcttaggaatcaaatttattgttaaacctgtcatgacgactaaagaatcaatggtcagtgtaaataaacaaaaaaggtttaggcagtctattctatgcggaattttaattggttttatttgcggttttattggtgctggaggcggtatgatgatgctgttgattcttactagcgttttaggatatgaattaaaaacagctgtgggaacaagtgtctttatcatgacttttacagctcttactggagccgttagtcactttgcaattggtggcatcccagatattagcgctctgcttttttgtgttttagcaacactattatgggctttgattgctgccagatttgctaataaagcttcaccaatcacattaaatcgagctactggtatagttttaactatcctgggaattgctattattggcgtaaattatttttaagattgcaaatagttttctaagatttatcaatattagaaaactattttattttgaaaatcaattttaactgtttattctacgactttgattgacttttatattcaggatttattataatggacaatacagaacttattataggagaacgaaatggagacaaaaaataaacgtagtacattttctggacagcttggttatgtaatggcggttgcaggatctgctgttggtctaggaaatatttggcgctttccatatttggcagctaaatatggtggtggtacctttctatttacttattttatccttgcaattacctttggttttgcgcttttagttagtgaaacggctttaggtagaaaaactaaaaaaagtcctattgctgcttataagcaattaggagctaaaaaactacagcttggcggctggttaaatgccattatcccgatgttgatcgtgccatattactgtgttgttggaggatgggtgtgtaaatacttatttgaatatcttactaacaattctaccagtttaattattgatacatatttcactggttttgctgcttcaccagtacaaccagtattctggttattaatatttgctatcctggtttttgcagtagtaatgttaggggtagaaaaaggtgtggaaaaatgcagtaagattttaatgccaactttagtagtcatggctatttttattgctggatatgcgttatttacgccaggagcgctcgaaggagctaaatactatttaattcctgatttttctagattttcgatcatgaccgtagtagcagcaatggggcaaatgttttattcactttcgataggaatgggaattttatttacttacggctcatatatgaaaaaagaaatcgatatggaacattcaattactcaagttgaaattatggatacattaattgcctttttagctggtttaatgatcatccccgctgtatttgctttttcaggtggtaatccagatacattaaatgctggggcatcattaatgtttattactttaccgaaagtctttaatagtatggcttttggtaatattattgggatcgttttctttttattagttttatttgcagctttaacttcagcaatttcattgatggaatgctgtgtatcagtgattcaggatcaatttaattactcaagaaagaaatgctgtagtattattctaataattatctgtattttaggaattccctgctcgttaggttttggggttttagattttattgccccacttggcttgagtattcttgatttctttgattttatgacgaattctattatgatgccaatttcagctatatgcacctgtttattaattatcaaagtgaccggatttaaaacagttattgatgaagtagaatatagttctaaattcaaacggaaaaaagcatatattttctgtatgaaatatattgttgttcctggtctgttgattattttaatcagttcaattctttcaactttaggtgttatttcaatataaaaacaagtattttactacttgttttttaatttattataagccacacaaccaaagaaaactattattactcccagtaatgtatataacgatattaatattatcggtgtcatactaaaatctcctttgtttatcttctataaatcaatttctaaaccaacaggacaatgatcacttcccataatgtccgtataaatatatgcatcattgattttatcttttaaacaatcagatacaataaaataatcaattcgccatccagcattatttttacgagcattaaaacgatatgaccaccatgaataaataccttctaaatcaggatataaatatctaaaagtatcaacaaaaccattttctaataattgtgtcattttagctctttcttcatcactaaaaccagcatttttacgattagttttaggattttttaaatcaatttcacaatgagcaacattaagatcaccacataaaataaccggtttcttcttttcaagctcttttaaataagctaaaaaatcatcttcccataacattcgataatccaaacgcttaagctcattttgactatttggagtataacaattaaccaaataaaaattatcatattccaaagtgatgactcgaccttcttgatcatgttcttcaatattgattccataacaataactcaatggttcaatttttgaaaatactaaagtgccactatatcctttcttcttagcactattcatataagtaaaatagccatgcttctctaattcgatttgtccttcctgcatttttgtttcctgaacacaaaatatatcagcctgactatcttttaaaacatcataaaaacctttagttatacaagctctaattccatttacattccatgatattaatttcatctagatacctcacaatctaattatacatgaaagcatttttatatagaagtatttttttctaaaatagaaaatattttatcaatctttatcacttcttaatatttttttataaattgttaataatgattatggtgattaaattgaaaaaatacaaatatataattcttaatgtagcaatatctttagggattggtgctttgagtgccttttttacaatgaatgctatggatctctatataaaaatcaatcggcctaaaatagcgccacctggttttatttttccaatcatttggacaattttgtatgtattgattggtttatcaagttatctaattcatcgtagtaacgaaaaacataaagaatctgctttaattctatattatttccagttagctttaaattttatctggccaattatctttttcaactatcaaaactttcttttagcattagctgatttattatttttaaacatttctgtaattatcttaattcgcatgttctataaactaagacccattgcagcatatttactgcttccatatttagcctggttattatttgccctatatttaaatttttggatctttttgcataactaaaaaagtaggcctagacctactttttattaccaatatattttaaccacacacagaaaatattctacatactcatgtcttacttaataccaaaaaaataacttaaaagtattacaataataataaaaccaccaataactaaaccacgacctgccaaagcacgtccatagtctctcatatcttcttgaatttctttagttcttttaggatcttgaaatctaatattttttttcgccatattctatcaaggtacattaagtgtacttgtacctgtcatattaaaagtttgtccagcggttaaaatacaagatcctttaaatgtaattcgtgaagatgtttgtgatgtcacagtaactttaggatttgaatatccagttgcaccagaataattatttatacttacaacaacaggattttcatatcctacacatgatgtgcctttaaaaaatacattaatataaaagtttatatgtgcatttaatgctgacatagctgctgcaccagttcctttacacactacagtacaattataagttctataataatcataatttgacggaactgctcttggtgtaaaaatagctttagaaattgaatcgtatctagaatcaaaaacaactacactactatttaaatcatctgtagtttcaaattccataatttcaggtacatttcctctaaatgctatatttaatacttcatcctcagtatagacttgctccatagcaaatacatgattattattagaaattaagcaacatgcaaataaacaaataacaagcaaaatttttttcattttatcatttcttcccttctcccatgtgtggttacaaatatattatactatatttcattaatataatccatttaatatattaataatatataaataatgatatttgtcatatatttgatttaacaattgtcattttaaaatgccatatctaaataagacatggcattttaatattaatatagtaattcaatttttaatattcacttttaaaaatctaaatcaaagcaaaatatgcaataaagacaagaatcaaaacccaaacaattggcttaatatcttttgctctaccagcaatagcactagtaagaccataaacaataaaaccaaaagcaatcccatcagaaattgaatacgttaaaaccatcataattacagtaataaatccagctgctgcaaaaacaatatcatcccattcaattcctcctaattgtgttgccatagaaattcctacagcaatcaacgcaggagcagtaactgcattagttactacacttaaaactggagcaaaaaatattgataagaagaaaaggacagctgtagtacaagccgttaaacctgttctaccacccgcttcaacaccagcagttgattcaacaaatgaagttacagtagatgttcctaaaatcccaccaattactgtacccgttgaatcagcaataagtgcttgttcaatatttgcaagttcgccatttttgtctactaaattagttttattagctactgaaatcaatgttcctgcagtatcaaagaaatcaacaaataataatgaaaatagtgctacgatacaatctggatgtgagaacaattctccaaaaccattcataaagattccaaatccgctagtatctaaatcgaatgatataatagctgaaggtacttctggcattcctgctattccgcataatcccaaaataactcccacaacagcagtaatgatcaatccataaaatactgctgctggaacttttctagccattaagataatcgttactaaaattccaaataccgcaagtaaaacaactggatctcttaaatctcctaatgcaacaaacgtagaggcatcactaacaataattcctgcatttttaaaaccaagaaaagcaataaagaaaccaattccggcaccgattgctaatttcaattgctgaggaatagcattaatgattgctttacgaatacctgttactgaaataactaagaaaattattcctgatactactactgcagctaatgctgctgctggactatatcccattccaaatactaatgtatatgtaaataaagcattaactcccattcccggagctaaagcaacaggataatttgcaagtagacccatgatcaacgttgcaattcctgaagataaagctgttgctaagaaaaccccatcataagataaacctgtttcttgcaacatgttcggatttaccgctaagatataagccattgctaaaaaagttgtaattcccgcaatcacttctgttttaacagtagttcccttcttttttaatttaaaaaatctttcaagcattatttctttctccttctacaaattctctttaattatatcttaaatttgtgccttttcaagaaaaataatgcttcaaataatatttacataaaataaaacctcttccaaagctcttgtcttcaaacgataataagtagcccgactataaaaatcaacccaccagtcatcttctttttgatctacaaattcattagtaataatgatttgactatcgggactcaatgctttaataatgatttcaaaagaagatatcaagctttttaattcatctttgtcttcgatcctactatttagacgctcagctattgatcttttataacgcctctttgtctctttaataattcccgcacttacctggggataataatttacattttctaaacaatataattttaatttagcccgatgatattgcttaaataaattttcaacagcatcctgcttttgtttaaatgttaaagtattagttcttcccataaaaaaacctcctattatcttatacaaatcaaataggagatttacttctttaaattacaaaattttctattatttctaaaattttttcttcttcaacaccacaactgatcaaatattccttagcactaccataattatctcttaaataatcaagaaatttcatcatcattcgtggctccgattctaaataaacccgattttcaacatccacgagtttttccaattctggtatcagctttagattattttcataagactctgaataatccttaacgatatcatattcatgacatcctgctagatctaataacaaagctgcaacaacacccgttctatctttaccagccgaacaattaaacatgatcgcatcatagggattatcataaaatatttcaaatacttctttaaactgctctttgttagcttccagcataaagatataaaaacctgccaagtcatgataattagctatctctttaggtagaacatttaaatctttgaccttcatcaaattaatacgataatatttaatatcttgataatcttttaatgtactaggctgctgttctaattcgaaattacttcgtaaatcgatttgaaccctgattccatattcatataaatattctttttcttcatcactcaatttacctggattagttgaacgaacaaacttatgacttttagtataataaccagcctgagtttcatacccgcctagatcacgaatattagtcatactttccacttttaacattctttcttctcgacttaattgcatcattataatttacctcactgataaaattataccataacatttttagatacacaattttctattcttcaaaaggccgtactcttaatgccaccccgagatcatcagcaatcttttgacacttagcgatcttttcatcaccaataatatcaactactgtcaatacaacattttcaacatattgcttcgtctttaaagtaaaatccagcatataatcaaatgaatcaataccatattttgatcttgtcaactgataatattcttctttacttggagcatttaaactaattgaaacagtatcgatcagtcccttaaaatcaggagtaatatctctttttaaaacaatcgaagataaaccattagtattaattctaatttgtagatcttttcttgtttcctttaaatatttagctacttgcatcaaatcatcatggcgcatcaaaggttctccaaatccgcaaaaaacaacttctttaaaatcatttaaatcatatttcttaaactcatctatgatcatttccacagttggttcctgctctaaccacaatgaattagattcttgcatttctttagtatttcttaaacaaaaagtacacgcacaactgcagcgattagtactatttacataacaggtaacaccttttaaatcatctaattccttaatatcaagataactatttttatatagtgtatataaaataaccatttattttccctcctacagctcctttaaaaacggttcaaaacataaccctaaatgattatgagcaccaattttttggctataatcaatgcatttagaagcaaaatcaactgcagccttgacactttgataaaaatcatgatgcaacaaatattttccggcaattactccactaataacatcaccggtaccactacgatctgcgccgattcttttggctttgataatttgataatccttaccatcttcgtaaacaaaattaattatctcatcatcaatactaattcccgtaactacgatcattttaggcccttgactagataactgcttacacattttaaacaattcatcgaaatccggtatcctattaggatattcaatattcaaaagagcacatagttccgttaaattaggtgtcattatcgatgcataaggtattaactcacgcattttttcttgcattttagcagtgtatgtaggatataacttgccatgatctcccatgacaggatcaactaaaacaaacgtattttgatgtttaaaatatttaataaaatcaataacgatatcgatttgttttgctgaacctaaaaaaccagttacaataccatcaaattcaagttccatatttttatatgttgcaatataatcattcattttatctgtgtaatcatcaaaaaaatatccaggatgatatgtattgatcgataaaatagcagtcggtacaaatacacattcgatcgccatagcagaaataattggcagctgcacggcaacagaacagcgactgtaccctgtaacatcatttattaaaacaattcttttttgtctcataaataccctcttttcattgtcattaattttatcatatttatagataaattaatcatgacagttttaattatttttatgtggacaatatttatctaaacttttgtatagacaattaatagtaatattttgtataataaataagaaaatgaaaaggagatagtatgaaaaaattatttaagattggtatggttatgcttcttgctttagctttagcaggatgtggcggagacaaagatactgatagcagttcaaaaaacagtacaacagatgatttactaagcggtaatcatcatgctgaaatcgatgttaaagattatggtgtaattaaagttgaacttaatgctgatgaagccccaattacagttacaaattttgttaaactcgctaaagaaggattttatgatggcttaactttccatcgcatcatcgatggttttatgattcagggtggtgatcctaatggtgatggtacaggtggatctgatgaaacgatcaaaggtgaatttagtgctaataatgttgataatattttaaaacatactcgtggtgctatttcaatggcgcgttctcaagattatgatagtgccagttcacaattctttatcgttcatcaaacatatccttcattagatggccaatatgctgtttttggatatgtatatgaaggaatggatgttgttgatcaaattgctaccagcgtacctttaacagatgataatggtacagtagaggcccaaaaccagccagtaattacctcaattaaaattattgattaaaaaatctaatctaaaaaatcaacttttttagttgatttttttgtgtcttaaataagaatgattttcacaaccatgatctgtttccttgcagctaataacatttattttagtacatcttatattcatatcctgctttataacgaacagatatttaaaatcaatattatcttttttcatttactgtttacttgattttattaaaacgatattttgacaatttatatctctataaactaatatttgttcctaaatatctattactatattatctttaacatcccaataaaacaattctacattaccttttaatttctttatttccttttgaaattctcctggtaactttttaatatcattatcataattataacttttattgatttttgtttctgataatccactatatagccatcttttgttactatttataactattacacatttattatttcttaaaatatctgttaaatcagcacataatctattataatcctctttttcaccaaaataatgtgtatgccacttataataggataaagtaaattctccaccatcttctaaatcaatatacattgaatatttacaatttgaattagatatagtaatacaaatatcatttccttttaaatattcatattccttatcagaatttacattataaatttcatattggcagtttagtctttgtaacaaagaacagatatcctgctttttgctgattggatttatttcattactacattccattttcatatttccgccacaaacggggatctatcgttctgacatatatttctgtacttcatcaaaagtcaattttcgtatttgggtatttgcgtattccttatatttagcaacaatgaaaataggtttcatacgcttacaaaatttacctttattcttttttaagtatatctgtaaatctttatcccttgcaaaaattttaaaggaatgtctgccgttttcactttctatttcataaataccacaagattttttcatactgtaatcagcagtacgcaaatacatttttgcaatttctaatgacttgaaaggaaaattccatctttgcagtccccgtttagggtcacgttcaatacagatacaccgtccacaagttccataaatatattgcgtatgattttgtaaacattctatcgggtttaacagcggggttattctattttcatcaatataacattcaatacacattattatttcacttccttaaaaattctcatttattaatttcatttttttgaaagctataaatttcttatctttatataaaaataaatcaactttataacataaatattttacttctaattttttctttcactaaagaaactacatcacttattgataattctgttgtatctatagcatttacttcataaactcctaaattattaaactgctcccacattatttccactaattctatgtttgtctctttatctaattttgaacgatttattactcgtttcatcgtttcatttttacttgcccttaaaataatgtaatgtacttcatatccatctcgaacaatatttagccacggttctaaaaaccatggtccaataataccatctacaatgacgtcatatccgccacgagcataacgttttgcagcttctaaaaaagcctcaatgacaattaaattttgcttatcagattcaggcaggtgtggcgatattgctcctttgctcaaatagtgataaaaatcatctgtatgcatatgtacagattttttcatatcagattcttctgcaacaacagtcgatactgtagtttttcctgtccctggtgaacccgtaattaaaacaattcttccactttccataactacacctccgccttaaattcaggttatctcttgctatacaaatggggactctgtttggacttatcttctattgattctccattttcgtcaatttctccctcaatccatgccataataccaaagttacaaaaaggacatgtaattgcttctttgaaaacctcttgtttgcagcgtgggcacacaacatattcttcattcttcatattactcacctgtttatttctcctttgcaaattataatttacagctttttactaaaatacaaaacgtcagacataggattatgataataaggtttacactctttaaaacccagtttttgatatagatatattgcagatttcaatggggtgatcgtatctaataccatttctttataacccgcctttttagcatgtaaaataatttctgtaatgagtgtttctcccaagttcataccacgatatttcggttttacataaagacgtttcatttcacagcgcatattagaaagtcgatgataagcaaccattcctaagacttcactatcttcaatcactactaaaatttctccttctggagctgtatattttttagccggatcagcaagttcatcatctatttcttgaaaagaaagatctctatcaagccattgtatatattcaataatgagatctcgtacctgttctatatattccttaccatcaactattttcatcttttcctccataaattttaattcaccattttattttatgaacaagtctattcaaaacaaaaagaatcaaactaagcagatacattaaaacataaataacaattcctgcgattattgcataaacaagcgtaaatttttcagaattgataaaaccgtaaacaaattcacctgtaaactggtagtgtatataatcaaacaatacatatgccatgatcattatcggtgctttcaaaacatacccaactttacgatcttgctcgttgacaaaaattatataatgaaccacaaaaacaattggattgatgacatgcataaagaaaaatgcaccattgaagttaaacttatatgctccaataagacttcccatacaaactagaaatactataagtatgcttactgtaatattcatataaaaagcattaggaaaagctttcttttttgtgatgttaagcaccccatctaaaagcaaaagtaatccaccaagcatatttgatacacaagtgagttcaactaaatactctggctggggaatatatccaattaaaacaactgcaatcataaataagcctactataattttaaatatgttttttatcatctattttcattccttcaaattctaatttatcgctcatcctacaaactaactacttgcattttttatcttgtaattcattaaatgtctgcttaaatttctatatagaaaaaccgatatttcctgatgatgttctttaaataaatcatctagacaatcataaatttcaaaatcttgattaattccttcaatttatcgctcaaaaacaattatcggattacaaaaatcttttacagcaacaccatgccataaaaagtatttcttttgtattacattgtccatatctatcagccaaaacttttgatgctaaaatactactatccccattgtaatctaataagatttaatcacgaacaaaagatacgatgatcccatcaaaattcttccactttctattacttatcaaccattgtatattcgtcgccgaatcactccattaatatttcctaacaatttgttcatttcattataaataattataacatgaatatatattacattcatcccaactttaaaataatcaaagtatactatatatttctatccagcctttacataaagatctgcctgatctttggatcttaaattaatattttaactaaacaaaaaggtcatttaattgacctttttaattctatattgatctatagttatgttttactaagataatttttttattgctttgataaacaaacaaatcgttattacaaacgcactaaaatcagcaatcggcactgccataaaaataccatctaagccaataacagcagctaaaagcaatatcattggaatcaaaataatgacttggcgtaataaattcaagacactagctaccttgattttaccaatacattgaaaataattagccataatgatctgcgctcccaataatggcaaacaagcaaaccagatcctaattgctttaaccccaagttcaactacatctttttcactattaaacatcttaatgatcgtttcgggaaaaatctcaaccgctaaaaagcccgtaaccgcaatgattgttccaccaataaccgcatattttaaagtttctttcacccgatcatattttgccgcaccaaaattataacttactaatggctgttgtccctgcattaaccccgttaaaggcatttgacaaatagtttgaaaactcgtgatgattcctactgccgaaatcgcgatatcgccaccatatctacctaaagtactattcaaaataaagtttaaaacactatttgccatctgcattaaaaacgcaggaattcctgtttttatgatatctaatacgtaatttacctttaattttaaacaatctaaatccagcttaattaatgatcggtttgaacataaataacaaagctgccagatcatacttaaaaattgtcccccaatcgtagcaatagccgctccatgcattcccatatgtaatttcataattaaaatataatcaaataaaatattaaatcccgccccaatcaactgagaaatcatcgcatttttaggattaccttgagctcgtgaaaaattattaccacacattgcaacacactgaaaaacagccccatataatacaattgataaataatctctagcattaccgataactttatcactagcccctaagattcttaaaatcgggtcaataaaaatatttccaaaaatcgtgaaaatcaaaccaaaaataatcgttaatacgacggcatttccttgatagatccttgctttttcaggctcttttttacctagagaaatactaaaacgcgtagccccgccaacaccgaccattaaagaaatcgctattaaaactaaagtaattggataactgatcgttattccggcaataccaattgcgcctaaatcaggagcattaccaataaacatccgatcaacaacattatatatagcattaaccagcattccaattattgctggaacactaaattctaccagcaatggtaagatctttttagtttccattctttcattattcattgattttccctccgtcaatattattctttatgatttccagcattcttctaagttcagtttgctcctctttagacaaaccagcaacaatatcatgatcctttttattaaagacacgatcaaccagcttttgtttttctagtcctgattccgttattccaattaaacaataccttttatcattaggagcctgaattcgcttgattagatttttactttccatccgttttaataatcttgtcaccgcacttttatcaatttctaattttttgataatatcttcctggtaaagttccggtttttcattaaacatcaataaaacagcaccctcactgccagttaaattatattgtttcaatctttgattactatcattacgatttaatatcgctaactgattgattactttgcctattctatccataatcacacctccaacaattgacatatcaactattatattcaaattaattgatatgtcaactataaacaaaaaaacagtttcacttttaaagcaaaactgtttgatcttctaataagctttcgcaaaataaacaacctttttagctggtttaccacaaattggacaaacatcgccaaatggcttttcatcttctttaatacaacggctagtagctcctgtgtcttctttgatcttaacctcacagttttcatcgccacaccacatcattttgatgtaaccacccttagtattaagaatttctttaaattcatcatagctattagcttgacgaatatttttatcacggtgttttaaagccttttgatacatttcttcatgaatcgtatctaataattgcttaactgtattttcaagattttcatctaatggatatgtttccttagttccatcatttcttttagcaataacacaagcattattagcaatatctttaggaccaatttcaagtcttaatggaatcccgcgcatttcagcttcagaaaacttccatcctggtgtcttatcactagcatcaactttgactttaattcccgcatctttcaatctttgctgcagctcataagccttatctaaaacaccatctttttgctgttggatcggtatgatcatcacttggatcggtgctactcgtggtggtaaaactaacccattattgtccccatgaaccataatgattgcccctaataatcttgttgaaacaccccaagatgtttgataaacatattctaatttattttcctttgataaaaatttcatatcaaaagctttcgcaaaaccttgcccaaaataatgactagtccctgactgtaacgctttaccatcatgcatcaaagcttcgatcgtgtatgtttccatcgccccagcaaacttttcacgttctgttttacgacctgttaccattgggatcgctaataaatttttagctgtatcttcataaatatctaacatttgtaaagtttcagctcgagcttcggcttcagtcgcatgaatcgtatgcccttcctgccataaaaactctgatcctcttaaaaatggacgtgttgttttttcccagcgcactactgaacaccattgattatataatttaggcagatcacgataagagtttactactttagcgtagtgctcacaaaatagggtctctgaagttggacggatgattagattttcttctagatcatctaatcccccttttgttacaattgcacattcgggcgcaaatccttcaacgtgatcggattctttttgtaataatgattgtggaataagcatcggcatataaacgttttcatgtccagtttctttaaaacgtttatccatatattgttgaattgcttcccacattgcataactgtatggccgataaatgataaagcctttaacactgctgtaatccattaattcagcttttttacatacatctgtataccattgagcaaagtcatcctccattgcacatattgcatcattttttttattatttgccatcatatctcctcatttcattataatctttgtttattttactatttatgtctggattattcaatagaaatataagtttctttatttcctttagaaagaacgatcttatgatcgatacgctcttttagttcacttacatgagaaattattccgatcaatttaccatcctgctgtaaatcaatcaaacaattgattgcctgatccaatgactgactgtctaaagaaccaaacccttcatcaacaaatagagtattaagttcgatgcccccagcaaaactttgaatcatctttgataatcccaaagctaacgataaagccgctttaaatgattcgccccctgataaagtcttaacatctctaaacatcccgctttctaaatctaaaacatccagctctaaaccttgttttccagcacctttagaacgattatcacgacgatataactgatatctgccttgagacattctttttaacagaatgtttgcataagctaaaatattttcaaaataagcagctagaacatagcgttcaaatgagatccgatattcatttttaccagaagttatctcgcttaattctaagtagcgctgataattttcataattatcatttaactgtttatcaatttctttaatattttcaattgtttttttcatcatcattagtttagctttttgtttatttaatgaatcttgtaagccttctaattcttttttgaggatcattgtcttttcttctattttagaagtatcaacatattttgtattttccaattccttctttaattcactgatttgattttgtaatgtcgtcttattgatcaaataatcattatattctttttctttatcatttaataatactatttgtggtaataactcaataaaatgatcttcatcatcgaataattgttttaactgttcaagataaatatttgatttatcttgataattatttttttcttcctgtaactgcttaactaatgcctggtcattagtttctaactgaatcattttttcttttaaataatgataatttttttcaagtgcagcaatcaaagcatctagatcctgaagctgtttttcatcatcattgatcatttgattgatttttgactcggtcaattgttttaaatgatctaaaggagttattttccccactagttgatttaattgatcattataattactaagtacattattatcatcagttatcttcatttcaacttcttttaaatctcttaaatggttatctaaagtagttttaagcttattcaaataaataatctcattatccatttctttagcttttttcaataaaccactttctttaatattgatcagtcctaactccttaataaaaacctcttttcctaattcctcatcaatatcaagacgtttcgaatcagactctaatttatttttcaacaaagaaatttcctgctgttttagcattaatgcattataaagatcattacggcgctcgctacatttatcaaaactatgcttagctcgttttaaatcatcatgataaacaatatctttatcaaaactagcaatatggggatgatgcaacgatccacagactggacaaggctcgttttctttaagtccactagctaagattccagcttgactcaaacgaaaacgatgttcgatcatatcataattttgcttttcttttaaataactttcttcaactctttgaaattcttcttttaaatcatatccctgatcttcagtcaacaataatttatcataatcttcacttaaacgatgtaattctaatttatgctgatgtaacttttggtactcttgattgactaactcatagtcacttgttagtttatctaatttagaaatactggcactatcagtatcaatcaacttttggtatttattttgtttatcttctaaacctactaacctacttttaataattctgatctgtttatttaatctcgtttggatagctagatcattttgataatctttataaatttgtttcaattctttatttttttgtaattcaatcgttagtgccgcttttttttcttgatatttagcaatatctaaatattccctttccttatcagccaattcttttttagtctttatcaaaagtttttgactatcatccctagcagtcaataatttatctacttttttcttacttgaaagcatttcttgataagtattttgtaaactcatggcttttttcaacaataagatattttcttttagcttttgataatatccttgattatttgaataatcatctaatttaaactgtaattcatctaaatgtctgattctttgattattcaataatgttatattcaactcttgattgatctgattatactcttcaaacttcgtttgataaatcaattcgttatcctttacttctttttcatacatctttaaataagcttcatcatcaaggtttgtcggttcgatctttaaactatcttttaacatctctctttgcttaaataataaatcatatttatttcgatattctttgacctgttcttttaatttttcttccagatacactaaatcatccgttttaaacaagtttcttaaaactttttcccgctcatcactacccgcataaataagtttagtaaattccccctgagcaatcatgacgatctgtttaaactgtttttcatcaattcccaaaatttcttttatcttagcatttacttccttgactccatcaacaacttttccatctggcaaagttaataaagccgttggcattttaggcgtttttcgaccttctaataagtacttcggcgaacgcttgatcagatagtgtttgccatgcaaagtaaaatctaattccacatatgtaaaaacatcattatcagctttatcactccgaaattgttcactgcttctttcactgccgcttgaaaccccgtataaagcaaaggttatggcatcaaagatcattgtctttcctgagccggtaggtccggtaattagaaataatccatcttgtttaaaggtttcaaaatcgatcttgacaacatttcgatatggtccaaaagctgacattgtaagggtattaggcaacatgatcatcttcccccttcattattttagttattattgctttagatttatcatcgattggcacaccttttattttttgataaaactgcgcaaatagttctaatgaggacaatttttcaaatccctgatcagctttagtattattttttatttgctgactaattaaattaggataagttatttgtaaaacattagtgaattttgttcgtaaataatcgatggcattaggaacgatcattgtatctaataactcaactgcgataaaatcatgatgattatcttctaaattcattatttcatcaaatgaccccgagaatttaattagattctgtttaggctttagtgctactaatttaaatgatacttttttatcaacgatcgtaacatcgacaatacttttttgctgtaacacttcatcaaaagaataacgtattaaactaccactataacgaattgtttcttttgcaatcttttgcggcgcatgaatatgtcccaaagctacataatcaaacggtttcactaaagaaacatcaattatttcacttcccccaacacttaaaaccacttcactttcactacgtacaacttctttattaccagcgataaactgatgcgttattaatacattcgttgctttaaaatcaaaattctgtctttttaaatatgcttcaaaagcatcttgataagtaattatattttcatcttcaaacaaatagcgataataagaaggtttaaaaaaaggtaataaataaaaatttaccccatcaataatgatcggcttcatttccttttgtaaatgagcctcgatatataacccctcatgttttaataagccgctagcaaagcttaatcttgcagcactgtcatgatttccagcaatcattaaaacctttttatgatgttttaaaattaacgatgacaaaaaatcatttaatacttcaaccgcctcgttgctaggcacactgcgatcataaatatcgccagccataattaaaacatcaatttcattttcaactagataattagttatctgcttcaacaaatcagcctgaatttctaataaattctgttgaaaaagcagtttgcctaaatgaatatcactaatatgaacaaatctcattatctatctccttataactctatgatataaatttctttttcgctttcaccagcagcaaaattctttcttaattttttaggaactgcagctgtttctaaatattgtgcttttaattttagaattgtttttttagaagcaatattattaggtgaacaagttattatcagttccttaaaccctaataatgatgcttctttttttaataattgtgtagcttgaaaagcataaccatgtccttgatattctttttcaaccgtatatccaatatgaccatcataataacgttcttctttcgttccttcacgtaaaacgatctttccgacagctttatcatcaacgatcatggcataaatataatacggcttccatcctttaggtaagtttttatcaacatactcttcttttaccaatttcactttaatcaccttgtttaacattatatcataaattttatctttatttaaacttcaattcataaagtaaaaattttataaataaagacctgctttctattccaacaaaaatagctatattttgaaaacataatttttgacaagttcatagttcaaaaaatatgtcaacgaaatctattttcttgacctgtgtcatttcctctgattgtaaatactattcatttttataaaaaaaaccagtcaataaactgattctattttacttttaattttgtatttgattttacaaatctgcaatctgaaataataattatttcaccatcaatcatatatccaaagtcaattccttttataacaaaatgctaaatattcttatatctgttatcattgcatacattcttgaattaacttttatatgatcgatgcctattttaagctatcgtgaaaattttatattgttttcttttaaaaacataaaaatactttcatcaataacaaccttcatactataatccttctctttctagaagttcaaaaaattcgccatctgaatatgcttttgctttttcttcttttataagatgagcttttttcttgaaagattttttataattatgtttttttatccgtttccactcatctttactaatttcctctatattcaactccattataatacctttttacttctttccttcacatagaatcaaaaagttataaatacattaatacattttttaaactcttgctaataaaaatatcgttttaaattctatattaacaaaattacaaaaaacaaacttttagacttatcttaaaattgtctataagtatatttaaagtaatataagaagtaaaaagtatggcttttaccatactttttatcaatttaaaagttattaaatataattttttaagatttcaattaaattattggtaacattctctaacgtatcatcgttaataaaatgaatatcacaagcatctaaatataactgatacctttgtttatttaagtcatataatttttgtggtccatcttttaatagcggtctagttgaagtttcaacatctttacaaatatcatcaatcggtcgatcaatataaacaataactccattttcttttaaatattgaatattcaaaggatttaaaacaacaccgcctcccgtagatataatatacccctctaacttagctatatctttacaaccatcggtttcattttctctaaaataagtttcaccgattttaaacatttcgggaattgtttgctggtgtttttctacaatatattcatcaatatcaataaccggacgctttaattttttagctaaaagcgcagcaatcgttgttttaccacagcccatgatgccaatcaatacaatatttttcatccgtatacctcaggcatgacgatagtttcctaaaactcttagtgttaaacaattagcttttaattgttctaaagctaattttacattatcatcatgtaaactgccttcaaaatcgatataaaaataatattgccagtgtttatctttgattggtcgtgattcaattcttgacaggtttatttgatgatctttaataacttttaaaatcgaataaagggctccagctttatgttgtaaagtaaaaacaatactaacacaattagtatcttcatgatcctctaactgttttgaaaaaacgataaaacgcgtattattactttcttcgttatgaatattttcttgtaagacttctaaatcgtataacttagcagccatttttgaagcaatagctgctaaatgatgatcattactttcgctaacaaactttgctgctgctgccgtattagaaaaattttgcggttttatatttggatatttctttaaaaaatccgttgattgggcaattccctgaggatgactatatacatattcaagttcctctactttagaacctttgattcctaaaagatgttgcgtgacaccaacactatgttcaccaacgatataaaaatcataatctcttactaaatcataattatcattaattgctccggttgaagaattttccaaaggaacgatgccataatcaatttcatcattctttaaggcatcataaacgtcttgaaaatgttcataattaatattatcaacatccccaaaatactctaataatgcttgatgagcaaaagcacccggcactccagcatacccaactttaatattttcagttttgggctcagctaatttatacgtatcttttaaaggaataaaactagcctgataactttttccaatatccatgacatcttgaataaaattacgagcatagtcttctagattaggattagtaatacgatcagtatttttttcaattaccgctttttcacgttgtggctgaaatatttccatatcatgggccaatttgtaagttactacatctttactaacctgcattctttgttcaaaaagtttgatcaactgttgatcgatttcatcaatttctttacgacattgttctaaatctttcataattacctcactaaatcaagtattgttaaagcggccatagcttcaacgacaactgttgctctaaaaacaatacatggatcatgacgtccatgaacttctaaagttgtattttgatgattcttgatatcaattgtctcttgtgccttagagattgaaggagttggcttgattcccacattaaaaactatcggcatgccattactgattccaccagtaataccgccattattgttagtcttcgtctttacaacatcaccatcataataataacaatcattagcttcactaccatacatctcactaattaagtcattaccaaaagcaactgatttgacagcaggaatcgaaaataaaagacttgatagatgactttcaatcgaatcaaagaatggttcccctaatccagcctctaatccaacaactgcacactcaatttttcctcctactgaatcttgattcattcgcgcttgatcaataatttctacaaattgatcatacacagcttgattcaagacaggatactgctgacccttcaaatatttcaatgtatcataagacaaacgcatatcaaaataatcatcatacttatttttgatacttaaaatatgggccccaacataaattcctttttgtgctaaaatctgttttgcaacagcaccggcgaacacgatcggagctgtgatccgacctgaaaaatgtcccccgccacgaacatcattaaaaccttgatatttcacaaaagctggataatcactatgaccaggtcgcattttttcttttaataaagaataatctttagaatgttgatcactattatagatcatcgcacataatggtgctccggtagtaatatcatcctgaataccactcattatctctactttatcagcttctttcctagctgttgacattttattttgaccaggtgcccgtcgtttcatttctttagcaacttcttccatgtcaagcttaattccactaggaagattacctaaaacaacaccaatcgctttaccatgtgattcgccaaaaattgtaatttcgattttatttttccacgttgatgacatcaataattcctcctaatgactgataatcttcccaaaaactaggataagatttttctacacattccatattatcgataatgattgcatgcttgcatcttgttgcagctattgccagcatcattgcaatgcgatgatcatcataacttgaacaatttccaccctcaaactcatttataccctcaatgatcatgccttcagacaattctgttaccattccacctaattcattgatttgagagcttgttgcttcaattcgatcacattctttaattcttaaccgtttagcgttaacgacctcacttttacctttagctaaagctaaagctacgcagacaacaggaataacatccggacattgactagcatcaactgtcgtagccaccagttcttgagcggttactttgattccctcatcaacaacatcaactgttgctttcattgcttttaaaatatctaatgttgctttatccccctgtaatgaatctaagtttaaatcttttaaaactacatcattaccaattgctccagcaacaagataaaaagccgcctgagaaaaatctgcttcaacgcaataatcatgagctgtatattcttgattacctctgacaataaagcttttataattattgttgataatttttatcccatattgatctaacatttgcaaagtcaaatcaatatagcctttagattctaatggtgaagttatttcaatgatcgaatcaccttttaaaagcggtaaagcaaatagtaagccagtaataaactgtgaagagatattacctgggatcaaataatgatcaggttttaattttcctatcacatatagatctaaaacatcttttttatatatataaccaatattttggcgctcaaaaatttcataaaatgtatctaaaggtcttttccctaaatttccgcgaccaataaaatgaactttattttccgcaacgattgaaattggtaccataaatctaagtgttgaaccagattcctcacaatcgatctcactattttgtttagtgtacgtagtcgttccatcaatgatcaaataatcatcatactcttcaattttagttcctaatgatttcatggctttgatcgttgcttgaatatcttttgaatattcaatattatcgatacgactaactcctttagccaaactagcacaaatgattgcgcgatgtgctaatgattttgacggtggcacttgaaccgttccctgtaatttagctggtgttatttttactgctgtcattttaaaccctatcctttgtttgaattaatgaaagatcactttgataaacataactatcaccaatttcttttaataatactaatgataattttttatttatattcttcttgtcaagactgattgcccctactagatcacttgtttttaaatcactatgagtaggtaaattatatttaagacagatcgcttcgattatatcactagtcccctcaggtgataaacctttttcttcagcaatttttgttaattgaaccattccgattgcaacagcctcaccatgagaatatgtctgataatgataatactgttcaatcgcatgtcctaatgtgtgaccaaagtttaataataggcgatcaccaaaatcaaactgatcacgttctacgacatcgcgcttaatatcaacacaacgataaattatctcatcaatatcttgataaagttcatcaaaattctgataattatttaatttatcaaataaagcccgatctttaatacaaccatatttaattacttcccccatcccatcattaataaagcgtttaggtaaagtttttaacgtatttgggtcaattaaaaccatcttaggatgataaaaagccccaataagatttttgccctctggcagatctaccgccacttttccccctacagatgaatctacctgtgctaaaagcgacgttggaatttggacaagcttgacccctcttaaataagaggccgctacaaatcccgctagatcaccaattacgccaccacctaaagcaatgatcaaatcagttcttgttagtttaaaatccaacaaagctttatatagcgatggtaaaatatcaaaccgtttagactgttctccatgtaaaactgttacatgctccacgataaaatctttattcaagacattagttaaaagatccccataatagctatatacctgatcatcggaaatgatcatgatcttattgccctgataaatttgtttaatatatttatcagcctgattcaaaatccctttttcaatataaattggataactattatcctttaacgcaactgtcaaatccatcgctatatctcctcctaaaatttattatactttcttaccgacaacttcagctatcttactgatttgttttaataacttctcatatttctctggtctcaatgactgtggtccatcacataacgccttttcaggatcgttatgcacttctatcatcaatccatctgctccacctgctactgatgcttttgccattggttccactaaccaccatttccctccagcgtgacttggatcgattatgattggtaaatgtgttagtttcttcactaccgggattgcttgtaaatctaatgtgtttcttgtatagctttcaaatgttctgatccctctttcacataatattatgtttggattcccgctggccatgatatattctgctgacatgatccattcttcaaatgttgcacttaatcctctttttaataagatcggtttttttgtccctgctcctactttctttaataaatcaaagttttgcatatttcttgctccgatttgaatcaaatccactttttcattaaattcttcaagatactgtgcatccattaattctgaacagattggcagaccagttgcttttttagcagctaccaaaatatctagtcctgaagatcccattccctggaatgcatatggtgaagttcttggtttgaaagctccaccgcgtaaaatattagctccggctgctttaacagctttagcaacttcgattacctgttcttcactttctaccgaacaaggtcctgcgatcaacgctagattttcaccaccgactttaactcctgatacatcgatgatcgtatcatctggatgaaatgcccgattcgctaatttatatggttctgatacacgcattacatgatctactgcctcatctacttcaatagctcgtggatcaactcgtgttgtatcaccaataataccaattattgattgtccagttccatgaacaacacttactcttaaccccttatcagtgacaatttttgatactttttcgacgtctttatctgttgccgtcattttcattacaataatcatttttttattcccctttattatttatttcaaccctgtatataaataaaagccctcttcctaaaaggacgagagcctatgcttcgtgataccaccttagttcatcaatatattactatattgatctcatcaagtacgctaattactattagtacatactcttacacgttaacgggtgtcaccggagagacctactactaacgattcagtcctctactccaagatgaattcaatattatctaatagactcttttccaccaaacaagagctctctatcctatttccaatatctactatttcttttcacagtatttataccagatgttgttgcaattattgtatacaataaaattaattatgtcaacacattttataaaaagtttttatttctcaaaatattagtccatatgagtctacacaattttggcggttatcgacgtttaaatacgatataatcatattatataaggagggggctttatgaataatatcgatacaactttaattggcaaatacattaaaagtattcgtctatcaaaaggctggtcacaagcaaaactcgaatatctatcaggaatatctgcttcatctattagcaatattgaacatggtaataaaggtatctcttataatatgtcaattccagcaatcgtaaagatagctcatgcttttcaaatgagtttttatgatattcttaatgattcaggttttctatcatatatcggtgatcagcaattcgctcaaaacaaatcacaaatttacataaccaaccatgagcttataaatctgttcaatcgtcttagtcctagtgaacagcaaaaatttgttaaagaaatttacttacgtgtcgaattatccgataaacaaaaacaacaaaatatgttcaaaaaactttaagtgatgagtttcatcacctttttttatttaaaacttctcttataataacattatttattctttaatgatcttaatacaacaaatatttactatttttaattcgtttttcataattttgattaaatattgcaaaaaatataacttttaaccataattcgacaaaattagccatcaaaatatgtcataatactaattgtaaagagaaaccactttacattctcatgagtaaagattttcttatataagtaaataaaaaaagtcaacattacattgactaatttacaaatggtgcccaagaccggactcgaaccggtacagtatcgctaccgacggattttgagtccgttgcgtctaccaatttcgccacttgggcaactaccgataactattataaataattttaattataaaatcaatagaaaattaaaatatttgtttatttattttaaaatatttattaatattattaaattagaaactaaaatacattaaatttaacaaatagtattgacgaattaattaaaataacgtattttttaatagtaatttaactagataaatttataaatagatggagtaataattatggaacatgataaaattttaaatgaacttaatgaaataactaattcgctagatgcaactactgaaactttgatcggattacaagaaaatgctaaatttgaagaagctatcaaaaagatcgatatagatttatatcttgaattaccaatccaggaattaagcagacttgctaatcgtctagcaaatctcactaacgaactatcaaaataacagacaagcacttgcttgtctgttatcttgatgactgatagaaggtaaactatgaacgaactatttaaacaacgcatgaaaaaacttttacaagatgactatgaaaacttcgaaaaagcattactacaaaaaccagtaaaaagtttttatctaaatcctttaaaaaaagatgccatttctcatttagagcaacacttcttgaccccacatccatatatcaaaaatgcctatttctttgactatgataactaccctcttggtaaacatccttatttcaattgtggtctttattatatccaggaacctagtgcaatggctgtagctaattgcgttgattttaaagaagatgattacgttttagatatgtgcgcagcgccaggtggtaaaacctgttttaccgcaagtcaattaagtgatcaaggacttatgatcgctaacgacatcaataaactaagagcaggcattttatcagaaaatattgaacgtttcggaattaaaaatactattgttactaattgtgatcctgtaaaattagagaaatatttcaataatttttttgataagatcattcttgatgctccctgctctggtgaaggaatgtttcgcaaacttgatcaagctgttaaaacctggtcgatcgataaaataaatgaatgtgcttatattcaaagaaaactcattgatagtgcctataaaatgttgaaaaatgacggtattttaatttattcaacttgtacatactctttagaagaaaacgaagaacaagtcgattacatggtcaaacaattaaacatggaattattagcaataaaaaaacagccgggcatgacttcaggttatcaaaatgacaaagttgtaagaatgtatcctcatctaaacaaaggtgaaggacagtttattgctttattaaaaaaacacgatgaagaaagtaaaatcagtaaaatcaaattattaaaaccaaacattaataaagaacagcttgatttaatcaacaaattctatcttgacaacttgaaggtaacggtaccacctttactatacaactcaaataatcatatttatgctatattaccacaatttcctgaattaaaaggtatcagagtcctaagaaccggtttatatttaggcgaatgtaaaaaaggacgttttgaaccaagtcactctttagctttaacattaactaaaaatgatgtaaagcgttattatgattataaagctgatgacaaagagataactaaatatcttcatggggaaactttattagggactaaccaaaaaggctatggtttgattttagttgatggttatccattgtctttttataaagaaagtaacaatcagataaaaaatttatatccaaaggggttaagacgatgaatcgctattatgttataaaagatgaagtatatcatattttaaatacagaatgttcaaaaagtaatcgtcaagaagctatcgagcatttatctaatgttgctaatatggctgtttttttagccaagatggaaaaactcgatttagaattagcagctattattggaattcttcatgatctagctgcctataaatttaattctcacttcgatcatgccaatcgaagtagtatgctagctaaaaatattttgactaatagtaaattatttacggatgatgaaatcatccttatcgtcacagccattaaaaatcattcctttaaagaaaaaaaagatgatgactatagtgaattaataaaaaatgcggacttattagtccagcatttaaatgatcctaatgccatcttttcaaaagacaaacagctcagattagaaaatatttttaattctttacaaaagcttcaataattggcgctaatttagtactattaacaacataactgctatgattttctttaggcaagatcaataattgactaccactaatatgatgagcaatattaaaggtatgtccttctttgatcatatcattactacccgctagaactaaagttctagcttttattttatgtaaaagataatgactaatatgaggctgttctaacatcaatttaattttaggatctttctttaatgcataaattattttcatttgccagtaaatgtgcttttttaaaccttgaggctctatatttgccccactgataatcaaatcactaattaaatcactttggcttgcaacaagtaaaccgacgattccgccatcactgaaaccataataaataacatcttttaatcctaaacagtttataaatgccataatatcatcagccattgcctgataactatatactttaactttagaactttttccatgaccccgactatcaatacaataacatttaaaattatcttttaaaaccgcaaccagatcatcaaaaatatgatgatcttcgccattaccatgaactaatattaaatttcttccttttcctttaacttcataaaacagctctattccatttacttcaagtatcatattaaactcctcatataattcttaatcaatataattataacacaaaaaaggaattttctatccctttgtgtgttctttaatacaagcctcaattcgatcatgaacaattttagcaatttcatttgtatgtaaatctttatattcatcataatacaaaggttttaaataatgaatcttagccgttgttttttttatggtgttattatcaaaaaccttataacaatcaatcatagctactggaacaataggagcttttgcctttaccgcaatcttaaaagttccccctttaaattctaaaatattatttccatttttacttctcgtcccttcaggaaaaacaaagaaattttcccccttagcaacctcattagaaacatatttaattactcttgcactatcacgaacattactacgatccataggaacatattcaagcattttaataacatctttaactaaaatcgtcgatgcaagttccttttttacgattgccctgatcggtctttcatgcgtttgaaaaattgctagtggatcatatagcccctgatgattaggcgctaacaaataccctgatcgatctggtaaattttctaaaccataacactcaagttcaacccgagcttttttactgataattgctacaacacggtgaataaagccataacgttcttgtagagtataattttcaatatgcttatacttatttactttatatccccaccagtaaggcagttttaaaataactctaattacgatcatgataattcttttcattacttactacctcgcttatatatttgtaaagtaaatgtttcaaacgctttttgttctactaaatgataatcatattcatcaaaattaggaaaatatgtctcaccagtatgcttaccaggaattctcgatatcaataattgatcagcgatcggtaaacattgacgatatatcgaagcacctccagaaatgaacaaatcttcaccactttgacgatactcttcgatcacttcttctaaagaattgcgaatctcaacgcgatcatcttcaaacggctctaaactaacaacgatcgttttacgattaggcaacggtctaccaatcgccttatacgtagtaagtcccatcaaaattgtcttattaacagttgttgctttaaaatgtttaagatcttcaggaacattccaaggcattccattaaaggaatccttcttaccaattaataaatcttcatctgtcgctacaataatactaatcattacacacttacctttccaactaatctaccataactttgatagtcttcaattttaatatcttcaattcgataatcaaaaatagatttaacttccggatttaagacaagtttgcatttaggcaatggctctcttgaaatctgttctttgattacatcgatatgatctttataaatatgcgcatcgccaatcgtatgcacaaattccttagcttcataaccacaggttttagcaagcatccccgtcattaaagcataggaagcaatattaaaaggcactcctaaaaaaatatccgcgctacgttgatataattggcaagataaatactttttatcagcactaacataaaattgtaaaaaagcatgacatggcggtaaagccatattatcaacttgtacaggattccaagcacatataatatgtcttcttgaaaaaggattattttttaaactgtccactaatttagctaactggtctaccccttcataattaaaattacgccattgacccccatacaccggtcctagatccccgtattttaaaacaaaaggatcatcttctggtaactttttaattttatcaacaaattcttcaagtgtttccccttgataatcagcagattttttgtaagtctcatatggccaatcattccaaatcttaacattgcgatcaaccaaatacttaatattagtatcgcctttaataaaccacaacaattcttcagcaataggtctaataaacatttttttcgttgtcattaaaggaaaaccatctcttaaatcgtaacgtgtctgatatccaaagacacttctcgttccagtacccgtacgatcatcacgatcttctccattttctaaaacatatttacacatctctaagtattgtttcatcttttacacctcgaatgatattgtacaataaaaattcatcttaataaactaaaaaaacacttttatctaaaaagtgcttatgttttgttcatcttattataatgacgcaaagaagtttttatggatttcataatatcaataatcaactttaattcattgagattacaatctgacaaaagatcattgacttcatcaatatatatcctctcagcctcgatcaaactgtcacatagcaaaaaatcagcagaaaccgctaatgcatttgcaatactaatcaaagttggcaaacttaatttagttgctccgcgttcaatatgtgaaatatttgtcggagaaatgtttgaaatctcagccaatgtctgttgagaaagattttgagaaatccgctcttctcttattcttttgccaataagtttgtaatcaattttcatcataattcctccaatgatttaattgtatctttgaaaaagatatcttaaaatatattgcacatcccattaggatacataatatattattcccgttttttattatttttattcattggttttttactatatatatttaaatttaactatgttataatttaacaatattagtcattttgtaacaattagttaatatttaaatgctatgatagagcagaaaggatgatcacgatgaaaaaagaagctcctaaaataaatacaagattacgtagtcatacaattattgttcctgaatgtatccgtaaagctagcgggatcgtaatcaatggcaaaagaataaaatcattattattttcaactgatgttgctgtaatttctaactgcaatgccgatgctgtaattgcagtatatccctttaccccaacaatgcagattactaatgcgattatcgacgtctcacaaagacctgttttcgctggcgtaggtggcggaacgactgctggcccacgagttcgtgaaattgctttagatgctgaattacacggcgcaacggctgtagtattaaatgccccaactaagactgaatttattcaagaattatctgactatgttgatatccctgttgtcttatcaattgtatctttagatgaagacttagaagaaagaatgctgcattcaggagcaacgatcgtcaatgtttctggaggaaaaaatactgctgcaatcgtaaaagaacttcgaaagatatcagcagactttccaattattgcaaccggtggaccatcagttgcaactattcaggaagttattgatgcaggagctaatgcagttacttacaccccaccttcaaatggcgatatctttaaattgatgatggaagaatatcgacaacgttgccataaagattaaaaataataattttaagggaatataaattccctttttattaataataaaaaagccctttatcagggcatttattttttatctttgatttgcttatttaacattgtaacaaactcatcaaaaggaacagttgtttgcgcttgttcaccatgtttacgatatgtaacagttttttcatcacgttcattattaccaagaactaacaaatatggtactttctccatttgtccttcacgaatccgatatcccaatttttcttcacgggcatccatttctaccttgaatccttcattctgtaataactcagttacttctttggcatattctaaatggtattcgttatttactggtaatacttttatttgtaccggtgctaaccataatgggaaaacaccagcaaagtgttcgatcaagataccaataaatctttcaatcgaaccaaagataacacggtgaatcatgattggacgaactttttcacctttatcatcaatatatgtaatatcaaatctttctggtaaattcatatctaattgaatcgtaccacattgccagactcttcctaaactatctttaacatggaaatctaattttggaccatagaaagcaccatcaccagggttaactttataatccttaccagctgctttacaagcagctccaagagcagcttctgatttttcccaaatagcaagatcaccgatatatttcttttctggacgagttgataattctatttcatagcttaaatttaaactgctataaacacgatcaataaaattgatcaatctaacgatttcgccttcaatttgatctggtgtcatataaatatgagcatcatcttgagtaaatgttcgaactctaaataaaccatttaaagcaccactagcttcatgacgatgaacttgaccaagttctcccattctaagcggtaagtctttataagaatgtaaactatttttatatactaataaacttcctggacaattcattggtttaatggcaaactcacgatcatcaaccatacttgtatacatgttctctttataatttgcccaatgaccactagtttcccataattcttgtgacatcataattggtgtcttaataaattcataaccttcttttgtatgttcttcataccagtattgttccaaagtgtttcgtaaaatcatccctttaggtaagaaaaatggcattcctggagcatattcactcatcataaataatcctaattctttacctaatcttttatgatcacgacgttttgcttcttctaatagatcaagatgttcttgtaaagcatctggtgtttcaaagcagacaccgtagattctttgaagaactttattttctttatcccctttccaataagctcccgaatgtttaattaacttaaaattcttacaagctttaactgtttccacatgaggtccgcgacataaatcaacaaagtctccttgacgataacagctaatgttagtaccatcttcaaaattattgattaaatcaatcttatattcatcatttttaaacatttctaaagcttgttctttagtaatttcttcacgaacgatacgtttaccatctttacaaatttttttcatttctttttcgattttagcgatatcctcatctttaataacatcatcacctaaatcaacatcataataaaatccctcactaactactggtcctacccaaaatttagcttgaggatataaatgtttaattgcttgagccattacatgagcacaagaatgatttaaaacacttaattttgcatcttctttaaaatcaatcatttttcttctcctatccagaaacgtaaatatgtttctttactttctttatcataatattcattttctaatttaccgccacatttttcaatcgtttttctagaagctgtattttctttattacatgtaattaaaattggataaatatcccattttttacagattccaattgcttcttttaacattgctgtagcataacctttttttctttgactcggggcaacactatagccaatgtgaccacctctttttaataagaattcatttaaacagtgtcgaatattgattaccccaactattttatcaccttcaatataaaaatagaccgtatcaggtacaaaaccatcttttaaattaattcctaaatgattttgtttttctcttttaagccaatcttcatattcattaaaattttgatttccaccgacaccattgatatattcttcaccataagcaaaagtctcattcatataagctaagatcatttcacggtgttcgatactaggataaactaatatagccatgccatccctccttttaaataaaaaactctcatccaaaggacgagagtatcgtggtaccaccttaatttgttattaaataacctcaaagctataacgcgctaccgacattctctttcgagtgttgcatatcagggagtacctaaatagcctcatcaagacttgcaccaaccgtcttttctctaaatcaaagcactatctagacatatcctaaatcatcgcatcttatttactcttttaattctactcatttattgactaaagtcaacaaatttgtttatttaactttatcattttgcttagccaaatactccattctaatattatcagtctcttttttaaatgctcgataaacatattttgaaggcattttatcaaacatcgttaaagtattacattttaagcaatatatacctggaatattacgaacatttatctttttgatccaatctccttgtgctttacatataccacattcattcgtattttgtggttcaactatctgtattctcattttcatcacccatcatacagtatgcactaataaaactaaaattattgtcaaataaagacatgtcctgctacttaactgtattaactaatttttttaaatctttaacttcctgaggttttaaaattcgatattttcctggtgtcaatccttttaaattcacacaacctatactaacacgatgcaatcttttaactggatgtccgacactttcaaacatcttttttacttgacgatttttaccttctaccagctttatttttaacattgtcgtcttatgttcaatatctttaccaacaactttgattttacaaggcaatgtttttactccctctaaataaactcctttttccaatttatttagtgttgaaccggtaatcaatcccttaatagaaacttcatagattttttccaaatgtgagcgtggatgcatgatcatatttgcaaactctccatcattagacatgataatcaaaccagtagtatcaaaatctaatcgtcctactggatatattctttcttttacatctgtaaaataatctgtaataattggtcgatcgaactcatcatctaaagtacaaacacatcctttaggtttataaaatacataatatactttattttcccctactatcggtttaccatcaacagtgataaaatctcctttttttactttagttcctaactcatcaactgcttggccatttactttaactttaccttgaacaattaaatcttcagcttttcttcgcgacgtataaccgctggcagcaattactttttgcaatctttccatgtttctcacctacttcgtatacattatactgaaatgtaaattaaaagcaataatatcagaaactaatttttaatatttattaaataatcggatatctctttaacaaaaattttttttacgataaaatataattataaaagacttggaggaaatattatgagaggaatttattcatcattaactaagattcgacgaaaagttttcgtcgaagttgcaaaactcgcttatgaaggtaatgattatagtcggattgaagatctgccctataaaataatccctggcgaaattgcaacttatcgtgatagtatctttttagaacgggcaatcgtcggtgaacgtctccgtctaacaatggggttatcattacgtccgatcgataagccggctccgatttctaaaggtattgaagatagcattattgccgataaatattatgaaccaccacttattaacatcattaaatttgcctgtaataaatgtgctgaaaaaaaatttgaggtaagcaatggatgtcaagcttgtttggctcacccctgcatggaaatttgtcctaaaaaagcaataagctttaaagaaggaaaagcttatatcgatcaggacaaatgtatcaaatgcggcttgtgcaaaaacgtctgtccttatgatgctattttaaaaaaagaacgtccttgtgccaaagcctgcgggatgaatgcgattgaatctgatgaatatggtaatgcccatatcaattacgataaatgcgtttcttgtggaatgtgtttagttagttgtccatttggtgcaattgctgacaaaagtcaaatctttcaactgattcaagcaataaaagaaggtgatgaaatcatagctgccgttgccccagcttttattggacaattcggagctaaagtaaccccagagatcctaaaaaaagcaatgcaggaacttggttttaaagatgttgtcgaagttgccatcggtgcagatctatgtaccatcgatgaagctaaggatttcttagaaaaggtaccagataaacagccttttatggctacttcctgctgtccttcatggtcaatgatggccaagaaagaattcccagaatttaaatcgtatatttcgatggctcttaccccaatggtattgacggcacgtttaatcaaggaaaagcatcctaacagcagagttgtttttattggtccttgcgctgctaaaaagttggaagcttctagaaaatcagttcgtagtgaagttgattttgttttaacttttgaagaaataggagcaatgtttgaagctaaaggaattgattttgcatctttacagcctaacgaagatgatccgtttacccatgctagcagtgatggtcgcggttttgccataagcggtggtgtagctaaagctgttgttaactgtattaaagctaaagaccctgaacgtgaggtattagtagaatctgcagaaggcttagaaaactgtaaaaaaatgttgaatcttgctaaaaaaggaaaatacgatggttaccttcttgaagggatggcttgtccagggggatgtgtcgctggagctggaactcttcttccaatcaatcgtgcaacgatggcagttaaaaaatacactagtacttctgataaattaaatgctaatgattctaaatataaagaatatttagatctattaattgaaaagtacaaatgatattaaaaatgcgcaatcaattagattgcgtattttttaatcatatttttttatttctactgtttgtttatcaaaatcaataaatgtttgaaaagcatatcgattttcatcttcatcccagatttcgacaaacttaggcgttacttcaatcaatatttcactatcttcatggctataagcattatagctttgccataaatattttttatataatttttcaaatttacgccctggttcttcaacaactaaacctagatttttagctagtccttctacttgaacaccgcccgtacataaagctacttgaggatttttaaataattgctgcgtttttctaaaattcttatctgttttaaaataaatcttatcatcataaaataaacaacttacatttctaaccattacataatcatttacactagaagcaagtgccatgatcttccaatctccaagttttttaaacaacaatgcttttccttcattaaactccatctcttttcctccctatttaatataatttttaatgactgaactaatttttttataaattataaatgtaataaaacacactactgcatttttaataagattaaaaggtacgattcctaaaataactaatttaaatgtactatcaacatacggattgaccgctttgcacatatcaatgatcatatccatattcataccatataatgctacgtaaaatggaataataattacaagattagtaaaaactgcaactataatattcgttaatgctcctactaacatcccctttaatgcaccttgctttgttttattatgtttataaattatggctgccggtaaaacaagagcaatacttaacatcagcccctgcaattccccagtaaacatcgaattggtacctgataaaacaagctgtaacaatattctaacgataacgatcaaaatcgctgctataggccctaatgtaaatgccccgatcaattctggaacaccagcaaaatcaaaacttagaaaaggcggcataaatggtaatggaaacctaaataccattaaaactgctgataaagcaccaagaactgcaatcaatactaacttttttgttttttcgtttttcattttcttcctcctaaaataaaaacctgaaaacaataaaagtcttcaggtagaattctagaaaatgtcttttctcatccggactttaaccgtcggtgttagaatttcactaactcagccatatcaatgatatgggtcatggactataaccatcggtagggactttcaccctgccacaaagactttattaaattttggatgatagaaacattatctattgacatcattctacacctctttatatataaaagcaattactttttcttctaagaaatataaatttatttttaataataagcattcgtaaatatttaacatcatgataaaacaattaatattaaattatcgaaacgcaggaaaaatcaaaaatttatttcaacatttttacctagatctattaccacattaacaacaaaaaagaattagatgatcattactgcattcaatcagaaatctaaactaaaaaataactatgattcaagtgagctattatgttaatgaaaaaagatattgttcatcatataaaagttttgctctattttttaatagtaaaactcaaaaaatataaaagcaaatatattttacttaaatttccttctaaactttataatttatgcatagatttataggggtgattaaaatgaactatataaaaatgattggcctaattatttctataaccttcatgccgctagatagtgttaaaactgttccttttcaaggcaagagttatatagttatggaagcaagtaatcaaattgtaattgaaggtagtaatgaagaatatattcaaagtgtagcctcaatatctaaaatcatgacatgtataattgctattgaaaatatgaaacttgatactattataactgttgatgatactatcaacaaagcttggggaagtggaatctatatacatataggcgataaaattagtttacgtgatcttctatatggtttgatgttaagaagcggaaatgatgcagctgttatgattgcaaaagcagtagctaaagatattcctaagtttgttgatatgatgaatgataaagctaaagaattagagcttcatagcacaactttttctaatcctactggtctggatgaagaagataatggtaatcaatctactgtttatgatatggccaaattaatggcctactgtcatcaaaatcctatatttaatgaaatcgttggtactaaggaatatacaagggaagatggcaatggaacttggcataataaaaataagttattaactaattataagtattgtatcggaggaaaaactggttttactaaaaaagctaaacgtactttgattacgatggcacgtaaagatgatctagatttaattattgtgacttttaattgtggtaatgattttgagtttcatcaaaataaatatgaggaatgttatgaattattgaaagaaactaaagtcttttctaagggaatcgtggaatttaaacaacagcagtattatttagattttgatatatgtgtgaataaaaaacctacagataaagtagatgtttcatttgttgatgatcaaatagttgtttcattaaataaccagcctgttagtaaacaaaaagtagttccatataacttttttcttggttttaaaatgattttaaaggatttattttatggctaaagtctttaaatttggcttagttttctttgttttaacagcctttgcaactaatcatcaaaatgatatgtttaaagcaatattagagtctcctaatcaagtttttgaattaattaaaattttagttttatccgcatgtttatggaatgggtttttaaatattatcaaagcttctggtttaataaagcaattatcatttatcttaaaacccatcttaaaattagtttatggtaaagctgttgaagatcaacaaatatatctatatttatctactaattttattgctaacttattaggggttggttctttagcatcaattagtggtcttaaagcaatgaaatctttaactaaatatcaaactgatcctaaggttccttgtaaagaaatgatgttgttagtaatcatcaatacaacaggattatcaataattcccaccacgatgatgaccttaagacaaagttacggtagtcatgatattttaggtttttttagttatagtcttataattggttttattattacagttgtaggaatcattgctagtaaggtgattgaacattatggatagtattattttaattataattttaattgctttaatagaagcttgttttaaaaaagttgatatttttaatgaatttatcgatggtgtaaaagaggggagtaaattattaattactttatttccaactatgatggcatttatcttatgggtgacttgttttcaaaactgtggcattatcaatatcttagaaatcgtttttaaaagtatttttaaaactataaatatccccatagatatttttatgatgatgatcattagaccattttcatctaatggatcacttagtgtcttaaataatgtctttttaaaatatggtgttgatcatccttttagtatacttgcctcaatcattcaaacaggtagtgatacaactttttatgttgttacattatattttggcagtattaaattacaaaataaccgctatgccctaaaattaggattatggttagatatcattgcttgtctgctggctattattagctttttgttatttattaattgatccaaatattattcctttttatcaactataaaaaataccagaaacaaaatcattttttgcttctggttttatctaatcttgatcaaaaatattatcacttaataaagaacgtataataaccttgaataaaaataaaaataatcacacatggtaaaacatatttcaaataagcttttgtccatttaggaaacttgatccctcttcccgtattagcctctttaataaaattatcaaatccccagccatatctataagtacaaaaaatcaaatatgctagtgaccctaatggtaaaaaattatacgtaactaaaaaatcctctaaatcctgaactgtagtaccagctccaaaaggagcaaaatcacttaaaacattaaagcctaaagcacaaggcaaagataaaactaaaattaaaatcaaattaataatcactgcttttttacgactccaattaaataaatccattccaaatgaaataatattttcaaacaccgcaataattgtcgataaagccgcaaaactcataaaaacaaaaaataacgtaccccaaacctgacctaaccacatttcattaaaaatacttggtaacgttataaacactaaacctggtccgcttcccggattaactccaaaagcaaaacaagccggaaaaattatcaaccccgataataaagccactaaagtatctaaagtacatacacttatcgtttcaccaaacaaacgacgacttttatcaatataactgccaaatatagcaatcgctccaattcctaaactaagtgtgaaaaaagcttgtcccattgctgcaaatattatctctaataaaccatactgttcaacggcctcaaaatttggaatcaaataaaatgctaatccctcactgcctccaggcagtgtaattgctctaataactaaaattaaaattattattaacaatgaactcatcataattttagtaatcttttcaacaccattttgaagtcctagtgaacaaataccaaaacctattgcaataactactaccatccaaaaaacttgtaataacggatcttgtaaagaactattaaaaatattttcaacttgctgaggcatggctcctacaaaatcacctttgatcatttttacaaaatatgataacatccagccaccaacagttgtgtaaaacatcattaaaacataattccctaacatctggaatttccctatccaattccaaactttcccttttggttgaattgtttgaaaagctagtgcagcactcttttgacttgctctaccaaccgcaaactccattgtcataataggagctcctaaaacaaccaaaaaaaacaaataaatcaaaacaaataaagctcctccatattgacctacaacgtatggaaaacgccatacatttccaagtccaattgcacaacctgcagagattaggataaatcctaatcttgacgaaaatttttctctttctttcataacattctaacccttcttttaatcgttaccttttaattttagcctagtatctataatttttcaactaaatgtttcaaaagtcgtacaatcgttataaataaactcatttgcatcatctttatttaatatttacatacttccaatatgagcgatatttccctttacaagcaattaccaaataattcgtatatccaaattctcttgcaatagttcctttagcaaccttattaacatgagtaagttttccatttacaacagcatatttcatttctagttcctcctttatattacttatattataaaggattttttttaatcatgctttgagttacccccatcataaaaccgaaaaaacggagttaaaatcaatttctttaattttcttcaaaatagataaaaagaaactgtaaaattacagttccttttcaatcaattatctttgatcatctattaatcttctttttttctttttaatattaaacctaaaccagaaactattgcaagagaaccaaataaagcaattgatgagttatctccagtatcaacacctggcttttcaggtttagcaggttcttcaggatcaactggagttactccaggagcaattactggtgtaaaagcattatcctctaatcttgcactagtatcaccatcaggccaattattttcatctaccaatactacttcaccagtttcagcatcaacataacttccacttgcaattgaagttacaatattttcataatcagcatttaccggtgtattagcattgatcgtagcctggaatattacttctttactttcaccaggttcaatcgttacattagtttgattagaaccaacaaattcaaaatactcagaatcaacaaagatatcttctaaatcaatatttaaagtgatatcaccagtatttactaaagtcactttataatcaataacttcaccagtaccagcatagaatccttttaatccgtcttttggttccgttacacgaactttattcattgtataacttacttttggtgtaatataatgtgtaacttcttctgttggtgtatcttcaccatcttctccagttaaaacgtcttttgcttttaaacttgcttgatttccaataacattgacttcactgtttgtttcatcaaatgattcgactactactactggaatctcaattactaattctccattagcttcgatcgttccttcgtagctgccattccaagcctgatcttgttctactccattaaccgtatattttccatccgcttttacttgatcaggtagattatctgttactactatttctctttcaacatcatatggattttctattgttaatgtatatgtgatcttgtcacccttagctaccgttgatccactttctggatcacttgtctttgtaatcgttggatcttttacaacgattactggtgtattagctgtacttgtttgttctaaatctttttgcgttgttttatcaatcgttacatcattaccgctttctggatcagtatatgtagctgttccttctgaggttaccgtattcaaatatcctttatcatcacttgctggtgtaccttcatttactgttgctttaaagattactgtttctgtttcacctttttcaagtctgatacttgcttcactagcttctacaaatgtaaagtaatcatcattttcaaatacatcatttaaattaatatctaatccaagatctccagtatttttgaaagtcactttatattcgattacttcaccagctccagctacaaagccttttaagccttcttttggttccgttacacgaactttgttcatcgtataacttacttttggtgtaatataatgtgtaacttcttctgttggtatatcatcaccatattcatcagttaaaacatcttttgcttttaaacttgcctggtttttaataacattgacttcaccgtttgtttcatcaaatgcttttattactactactgggatctcaattactaattttccattagctttgatcgttccttcgtagctgccattccaagcctgatcttgttctactccattaaccatatattttccatctgcttttacttgatcaggtagattatctgttactactatttctctttcaacatcatatggattttctattgttaatgtatatgtgatcttatctcctttagctactgttgatccactttctggatcacttatctttgtaatcgttggatcttttacaacgattactggtgtattagctgtacttgtttgttctagatctttttgtttgtttttatcaatcgttacatcattaccgctttctggatcagtatatgtagctgttccttctgaggttactgtattcaaatatcctttatcatcacttgctggtgtaccttcatttactgttgctttaaagattactgtttctgtttcatctttttcaagtgttatatttactgtactgtcaccaacaaatgtaaagtaaccatcattttcaaatacatcatttaaattaatatttaaatcaagatctccagtatttttgaaagtcactttatattcgattacttcaccagctccagctacaaagccttttaagccttcttttggttccgttacacgaactttgttcatcgtataacttacttttggtgtaatataatgtgtaacttcttctgttggtatatcatcaccatattcatcagttaaaacatcttttgcttttaaacttgcctggtttttaataacattgacttcaccgtttgttttatcaaatgcttttattactactactggaatctcaattactaattttccattagctttgatcgttccttcgtagctgccattccaagcctgatcttgttctactccattaaccatatattttccatctgcttttacttgatcaggtagattatctgttactactatttctctttcaacatcatatggattttctattgttaatgtatatgtgatcttatctcctttagctactgttgatccactttctggatcacttatctttgtaatcgttggatcttttacaacgattactggtgtattagctgtacttgtttgttctagatctttttgtttgtttttatcaatcgttacatcattaccgctttctggatcagtatatgtagctgttccttctgaggttactgtattcaaataccctttatcatcacttgctggtgtaccttcatttactgttgctttaaagattactgtttctgtttcatctttttcaagtgttatatttactgtactgtcaccaacaaatgtaaagtaaccatcattttcaaatacatcatttaaattaatatttaaatcaagatctccagtatttttgaaagtcactttatattcgattacttcaccagctccagctacaaagccttttaagccttcttttggttccgttacacgaactttgttcatcgtataacttacttttggtgtaatataatgtgtaacttcttctgttggtatatcatcaccatattcatcagttaaaacatcttttgcttttaaacttgcctggtttttaataacattgacttcaccgtttgttttatcaaatgcttttattacttctactggaattttaattactaattttccattagcttcgatcgttccttcgtagctaccattccaagcctgatcttgttctactccattaaccgtatattttccatccgcttttacttgatcaggtagattatctgttactactatttctctttcaacatcatatggattttctattgttaatgtatatgtgatcttgtcacctttagctactgttgaccccgatacaggatcacttgtctttgtaatcgttggatcctttacttcaattactggtgtattagcagtacttgtttgttctaaatcctcttgcgttgttttatcaatcgttacatcattaccgctttttggatcagtatatgtagctgttccttctgaggttaccgtattcaaatatcctttatcaatattagatggtgtaccttcatttactgttgctatgaatgttacagtcttagttttacctttttcaagtgttatatttgctgtactatcaccaacaaatgtgaagtaattagcattttcaaatacatcatttaaattgatatttaaatcaagatctccagtattttcgaatgttacttcatatttaattttttcatcagctccagctacaaagccttttaagccttcttttggttccgtcacacgaactttgttcatcgtataacttactttaggtgtaatataatgtgtaacttcttgtgtatactgtgtatcttcatattcttctgtattaccagttattttcttagcttttaaatttgcttggttggtaattatattttcttccatattcacaggatcatattcttttgtgacaactgttgggataataatggttagtttaccatttatatatatatcttcaccgtcatccccattaatttttgttgcagcagcaatttgacctgtccagctttcattccaatgacttccagttgcgataagattattatctttatcataaatcctgtatggctggctagtatcatatactacaccttcaggtaattcatcagtaacaacaatatctcttagcttactaaaagtattttcaattgttaaaatataatcaattttttgaccctttttaacatattcaccagaattaggattacttgttttagaaattgataatggtttaagatttactattttaccattttcagctccatcccccgtaatagtagcattaccttcgtcatcaatagtaattgtataaacaacatcattttctacataaccttcaggtgttatcgtttccctcatagtataagtggcattttctcccaccttaggcatacgcaaagttggtagatttacttttccatcgctacctgatgtcgcactaccaatagcattaccattatcatatacagtaaactctgcatctgcaacaggtttatcatgttcatcaacttttgtaaaaacaatatttttcccatatgctacttctatgctagtttgtccactaacagtaccaatatctgttgcctgatttccttcaccagttaaaggatcagcaactgttacattagttgacattactacaatactttcatcaataggatttgttgcaacattataactatcaccataatttaataatgcttgatcagtagttccttcaggagcagtgtaatcgttttcataagtgttgatatttccatttctgaaaaattctttattaacttcactaatttttggaacatttactggcgtattattacctccaatcgtaggtgttcccccagcagtaataggtttaatatcaacagtatatttaacattcattggaacactaaactgccaagcagcattatttgttgtatatcttctttctccattagaacttgtatatccagtttgtggagtataaagaaatgaatctgatttaaatgtataccccttcgttaatacatccatgctattaaaatatgtccgcaaactagcaacattaactgctgtattagtatatccttcttttggacttccttcaaaaatccagcctgttggatctttttcaccttcttcaaaataaaaaggtactggaacatttatagattcaggaactttattcacaaatgtatattcattcaaattacgttcgagttgtgatccaaaatcaaacgttaaatttgttgcatgagtcaattttatatttgattcataaattgcttttataccttgttctggtgtaccataaatagtaccgttattaatgtatatacgtacattcgaagatgttgtagttaatgcaacttcttcacttacaaaagcattaagaaaatcatcacttggaccatctaactcttgcaaactagaatctaaatcaacgtctattccaccaaatggtttagtttctgcataacttgtcacaccagatatagaaaacactgttactatggcaagcagcaatattaatatttttttgatgttttttaattttttcatcttttttcccataataaattagactatttaatccgcgtaaaatttattaatctcctttctttaaaatttttatttgttactggtatattgatgtgcatatcttaatattaagtagcacacactttaattatagcactctcatttatcaagtcaaatgcaaaaattccctatattagtaggaataatagaatatattttaaaataattgtttatattatcaaaaatttgattttatttattaataataactttatattaaataaatttattatttttataaaaatttgtttaaaaaattctgtcattaataatataaatactcttttaatcttaaatatcaaaaatcattaaataaactcaatcaataaaaaactgtaacaaataagaaaacttcctattcattacagatatttttaaaaattagtacaaacatttctcaatttattacttttataaccttcgatatttaaacaaacctcttcaattacacgattacgtgtttcgatcggtgcccatgcaatatgtggtgtcataagcaattttgttgcatctttcattaataataaaggacattcattattaaatggttcattttcaaaaacatctaaaccagctcctgcaagttgatgttcttttaatgcttctactaaatcattttcatttactattttacctcttccaacattaataagatatgctgaagttttcatttttctaaaagcttctttatcaaaaagattttgcgtttgcgcatttaatggagcatgaatagaaataatatcactagtttttaataacgtatcaaaatctacctgttgataactttgttgattattctttccgctagttgaaaaatactgaaccttacaatcaaaagcacttgcgatacttgctactttacgaccaatttctcccattccgacaattccccatgtttttcctgctaattcatggaaagtatgacctaaatgagtgaacattgaacttgaagaataatttccagaatctatgtagttatgataataatgatttttattataaagatctaaaagtaaagcaaatgtatgttgtgctactgcatttgtagaataacctttcacattgcaaactacgattttagctttattacaatattctaaatcaatattatttaccccagttgccgttacacaaattaattttaactttgaagcatcttttaactgctctgctcctaagtaatgcttattagtaattacaacactggcatctttaattctttcttttatttcttctttggagctttgatcataaactgttacagctccatatttatttaatttagacaaatcaacatcctttcctaatgtctcactatccaaaaaaacaatttttaaatcttcttgaagaatctctattacatcttttaatgtttttccacttaacattttacctaacaaaatagcttcattcaaatctaagatctttgatggcttccaattaccactcatcacaccactattaattttaaaactaagagctttattcaataaagcaattcctaacgcccgattagtcatatcatccatcttttcaatatcagccatgatcttatccgtaaaattaggatctattaccgaacaagacttgacacaatctaaaaaagtatcaaacttatttatttcttccctaaaaatatcattaaacaataaaggtaaaactatattataaagatccattggtacagaaccatatccctttgtgaaattatataatattgcactccctaatttttcatctttcattccatcaactaacttcatcttcttctcctaaaacatattcactataattctttgtcgatcttgtaaagtcatatcatcatatataataaagcaatacttaaatcttttataacgatgatcatatttcaatacattatagctcaaataacgactatcacattctttagctccactaccacatgaagaacctgcagcaattacatacatcccatcatgatccgtaaaaaacggtaaatgtttatgaccatgtaaaacatactggatctgatgttttcgaagccattcaactagttcctgactatcaactaaggccttagaactatccataattctaccaacaaacatcttttcccgccatctctgttttaaaaactcatctcttgtaatcggaaataaatgatggtgcaacattgctactaatgtatagttttttaaattaggaatattttctaattcttcatcaatattagctaactgctcttgtcccactttaccccgggctagattcccttcaactgtagagtcgattttaattaaaataattttttcttcttcaaatactttaatactttcattcaacaaaaaagcaatcactttactcttttgtttcttaaaaatattaaaaccatttacaataacatcatgattacctaaaataaacgaaacatcgcccccatacctattttttaataatttcataaaccctgatgcttcatacatattcttttgatttggtgaattcatcaaatcaccagtaattaaaaactttaactgataatatgaacgtaattgtttacaagtatcatctaaactttcctctaaagccaaacgaccctgatttttctttttgtttcctaaatgcaaatcactcaactgaacaaaataactatcataaggacttaaatatttacttgaaaaaatcgtcccatgttctattttgaacattgcatcctcaatatctttgatcgtatataccggtacaaaagcccaatcatcacctttaaaaattaataaacccggccagcgatcaatttgatacaaagcattaacaaaatgcttatacggaccataaaatgatagatcattcttttttaataagctatgacaatttaatacacttactttatcactacttaaatcttcaaccagctgggtcgaagttaaataaatattgattgactcatcataattaaaactagataacgctacaatttgatacttatctctttccacctttatataatcaattaactcctgatagtgcttaggatcaaatttatcaattatctgttccaccctcttagctttaataattgccataaatgtatcataaccaatattttcaattgcatttatgttaatattacgtttatacatccactttctaaactgacataagccacgatatccatcaagaatgcgactaaaataagttacactattatcataaatcaaattcaaataacagttgatcaaatcatactcattcattttatcgcctcctattttatattataccgcaatcaagtaaagaataaataattaaaatatattaattcaacgattttaaaagaaaaagcctataaaaataggctttttagaatttcaaatttcttggtgttcttgggaatggttcaacatcacgaatattttgcataccagttaaatacattaagaaacgatcaaatcctaaaccaaatccagcatgtttacaacccccaaaacgacggagatccatataccactgtaatccttctttactcattttcttctcgtccataattttctctaaaacatcatatctttcttcgcgctgactaccaccaactaattcaccaattcctggaactaacaaatcgcaagcagcaacagtcttattgtcatcatttaaacgcatatagaacgctttgatttcttttggataatcagttaaaaataccggtcctttaacaacctgctcacaaatataacgttcatgttcactgtttaaatccattccccaagatactttgtttttaaatttaacatctgctttttctaatatttcaattgcctctgtatatgtcattcgtttaaattcactatttcttactttagtaatacgctcaatacaatctttatcgatcatcgatgcaaaaaagttcatttcctcaggtgcattatctaaaacataatcaatacaatatttaaccatatcttcaataagatccatatcatcttcaagatctgcaaaagctatttctggttcaatcatccagaactcactagcatgtctagaagtattcgaattttctgctctaaacgctggtccaaatgtatacacatctctaaaagccatcgcaaatgcttcaacatgtaattgtccagtaactgttaagaaagcctctttttcaaagaaatcttctttgaaatttgtatcatcgatcgttgttgctctaaacatttctccagcaccttcaccatcattactagtaatgattggtgtatgaacataaacaaatccttgtgattggaaaaattcatgaatcgccatcgacaatacactacgtaatctaaaaattgcgtaaaacgaattagctcttggtcttaaatgaggaatttcgcgcatatattcaaatgaatgccgtttcttttgtaaaggaaaatcttcatcacagcgaccttcaatttcaatttctgttgcctcaacttcaaatggctgttttccctctggcgtcaatttcaatttaccaactactctgattgcacttcctgttgataacttatcaatttcagcataattttcaattccttgttcagtgtaaacaatttgtaagtttttaaaatacgtcccatcgttaagtgcaataaaccctaatttaccactattacgattagttcgaacccatccttcaagttcaacatactcataaccctctaaatccattacctggttacttaaaaacatttcatatagttctctaaccgttataaattcaaacatattaatcctcctagttttacatattatatactttatttacgcgactattcaagtattattgctgatttgaatccatcttaattactaattcttgaattgcgacaactacatcgacctgctgtacttcaacccctggtctaaccgtaaaatgggtatgagtaaaatcaacgattccttttattcctagatccatcaaacgatcgaccgttgcctgaacattttctgaaatagccagaatcgcaatcttacaatctctaggaaacgttttttctaaatcatcgatattatataatttgaccccaaaacgttcaccctctttatttttatcctgatcgtaaccacaaacgattttcccgactgtatattgccagcgattatattttaagatcgcactacctaaatttccgactccgatcaaaataatcgactcatctagacctaacccaagcacttcacttaagccatcgatcaagtgtttaacgtcataacctttaccccgttgtccaaaattatctgtttttgacaaataagtaaaatcccgacgaatcgtggtatcctggattccggttaattctgatagttcactagataagcaattttcttttccttcatgctgcatctttcttaatgcttttaaataaaccggataacgcgacatcgtcgcattagagatttttttatccatttcgatttacctcactaaccgattcattttcaagatccaaattaggttttatccctaaagataaatcactaaacatttttaaatcatacatttctttagctgctaaagcaatcatcatcgcattatcggtacaacagctcattggcggtaataataattcaactccatctaaatctttaacagctgtttccatagcttttcttaatccctgattagcactgacaccaccagccagcattacttgttttatcccataagttttagcggctctaattgttttattgaccaaaacttcaatcacgacttcttgaaaagaagcagctaaatcatctttatttattatttcaccacgctgtttagctttatgatttaaattaattactgctgattttaacccgctaaaactaaaattataactatcatcatctaaaggaacaggcaaatcataagtatgtttaccagcacttgccatcttatcgattaccggtccaccaggatatggtaagtttaatactcgacctactttatcataagcctcaccaacagcatcatctaaagtcatcccaattacttcaaattcaaatggtgctttcaacaaaaccagttcactatgtccaccgcttacaactaagcataaacttggataaatcatatcttgattataattattagcgtatatatgtccggcgatatgatgaactccgatcaatggtttatgatatgccatggctatcgtcttagccgcctgcaaaccaatatgcagtgatccaaccagccctggtcctttagtaaccgctatggcatcaatttcatcaatcgtgatattggccttttttaaagtttcttttaatactagacttacacactctacatgttttctactggcaatttctggaacgacgcctccatatagagcatgaacatcaatttgtgaagctactacacttgataaaaattcccgtttatcttttaatattgccattgccatttcatcacaacttgattcgattgctaaaatcagtgacatctttatacctccatttcttttatcattaaatatgcatcttcatgattatcctgataatagttctttctaattgctacgatcttgaaaccacatttttcatacagtttaattgctttttgatttgataccctaacttctaaattaatattaacatatcccatcatttttgtgatttcttcacatttatccatcaattttttagcataaccattaccctgatacgctttctttatccctaaagtcgttatttgcgtctgatcccctaataaccacatcccaatatatccaattatttctaactcatcttctaaaactagaattgttgaaaacgcatttttttctaattcataataaaatgcttctttatcccaaggggagctaaacagttcctgctctaaagcgacgattttatcaatatctaaaagatccatccgtctaatcagcatatctttttagcctcaacatcttttaaatactgcggtactagattatcgacatcttttacataatcgacacttttagctgcctgatatatattattacttaaatcaatttcaactttatcatgacccactatttcactatcaccccaaacagggtaatttgcatactgctttttaaaagtcgcaaattcctcaatcaacatgatttgatcagcgacaacgctatgattattatcataaacaccgacaaatatttttttactgcgggcatcaataacactgattgctttattttttccgacataaccatgcaaagaagatactgctttgattttgatcttacttatcgcagctaaagttttagcaatcgttaaagcaactctttgtccggtataggaaccaggaccgatcgtgatgatcatttcatcaacatcgagaacatcaaaattatttttttctaacatctcatttaaatatgttaaagcatattctgactggcgccgattgcctttttcttgatatttatcaatacattgaccatcttcatacaaagctattactaaataaatatttgatgtatccattacaattgttttcatttaaagtcctccatcaattgttcatatttagaacctactgctttaaaagtaaactcacgagcatcttcatcgatttttttaattataatttctaatctctccactggtaaaatatcagcaataaattttgcccattcaatcacacaaatatcatcactatcaaaaatttcttcaaaacctagatcagcatcttgatcttctaagcgataagcatcaaaatgtgatagattcaatctaccatgatattgttttaagatggtaaaagtaggactatttataatcttttcaattcctaatcctaaaccaattcctttagtaaaagtagttttaccagcccctagatcaccgcttaaagtaatcagcatttggggttttaagctttcgcctaatcttttgcctaattcaattgtttcttcgagattatttactttgattactttctccatctttacctccctatgttaaatcttcataaacatgataccagtgtttagtaaagtcttcattaaaaggcttttcaccctttgaagcacgatcaattaagatatttaactgttttttcaatattttatctaattcttttgaataattcatttgttttgcatgctgcttatattcttcttcatctaagattcggtaattcccatcaggaaatacctttagatccaaatcgtaatcaatatactttaaagcttcaccgtcatataaagttggagaagcaatattacaataataatagactcccgttttacgaatcatacaaataacattataccattttttcttaggaaaataacaaatcgccggttctcttgtatgccacattctcccatctgcttccgttaccaaagtacgattatttattgcaataaaatgttcctcattttcatctaaaataaatcccttggaccagcaacgatgaatacttccatcatgcttataacaatgaattaatactttttttcctatcagggaatttgacatcttttactacctctcttttataacagtaacattatacacaaattgagtgcctttttaaagatgtaactttaattcttgataccaatcaaaaaaatctcactaactggtaatgagatttaaaagactattatttgattgtattttttaatcgtggatatagaattacaaataaaacaaagcaagctactaaagttgctagattatatggaacattataagctaaatttgcttgtaacggtgttgcaaaagcataccatcctgaaattaaatgacaaatcgtctttaatatcattacaatgatgattccaatcggaagatcaaaatttttgatcttgatcaagggaataaatccaaccattcccacaattgccattggcagtaaataatcaaatattactgatagtgcgccataaaaagtcgctaatcctaagacaaaatgtaatccgacacaaactaacgaaacgacgattccatagcaggctcccatcaaataactgcaaagcatcaatactactagtgaaaatgcaacgtttccgccttgtggcatagttggtgtaaattgagttagatattctaaaacaatttgtaatgctgcaaatattgccatataagtcatggtcttggtgttgatttcaaattttttgtttttcatttttctttgtttcccctttcttataaaaagagccaaacaaaattaaaaaagcttttttacaagcgtaaaaaagcaaataatttaaaattgctctctctacgctggcattacccagttcagatgataagggacaaggttttatcctttctcagctaacgcgcccctggctcatttatattataaatgttatcgacaaaatagcaagaaaaaaacaataaagcttatgcatttaactagcaattttataaaatggtgttataatgtccatagattaaggaggctttgtgaaaatggcaaaaattatttctgtaaacgcaggtagttcttcattaaaatttcaattatttgaaatggatgatgaatctgttatcacttctggggtaatcgagagaattggtttaaatgattcaatttttacgatcaaatacaatggtaaaaaaaccgttacaactagttcgatcgaaaaccataaagttgcagtgcagcttttattagatacattaatcgaaaaaggaatcgtaaaagatttaaatgaaatcaaaggggttggacatcgtgttgttcaagggggcgcttatttcagctcatcagcagttatcgatgaagatgttgtaaataaaattgatgaattaaaatcacttgcacctttacacaatccagctcatttaacagggtattatgcatttaaagaagctattcctaatgctggtgctgtagctgtatttgatacagctttccatcaaacattagaaccaaaatgttatatttatcctattccatataaatactatactgattataaagttcgtaaatacggtgctcatggaactagtcattactatgtttctcatcgctgcattgaaatgatgggaaatcctgaacattcaaaaatcattgtcgctcatttaggagccggcggatctttaagtgctgttaaagatggaatctctgtaaatacctcaatgggctttacaccattagcaggtatcatgatgggaacgcgtagcggtgatgttgacccttcggtaatcgattatttgatcgaagaagtcggtatggatatgaaagaagttatcaagatgttgaataaagaatcagggttattaggtatttcaggaatatccagtgattttagagatgttcaaaatgctgcgatggaaggaaatgaaagagcccagttggcaatcgatattttctatcgccgcgtcattgcttatattggacgttatttcattgctttaggtggtgtagatgcaatttgctttacggctggaattggtgaaaattctttctttgctcgtaaaggaatttgtgatttattaaaagatgccttaggtattgaaattgatgaagatgctaatgtaaatggtcaaggcgatcgtttgatcagcacccctaattcaaaagtaaaagtttttgtaatcccaactaatgaagagttagttatcgctcgcgatactaaacgcttattaaacttataaaaatacatgtagctttaagctacatgttttgtctatgaagatcaaaagtttttttaaagcaacgattcacgaatcactgcttatcggcattctacttgctttagttgggggttttttagatatttatacttacattctaaaaggtaatgtttttgccaatgcccaaactgggaatatggttttaatggggttaaaattagctaatcaggattatcttggtgctttttactatttgattcctatatcagccttttttttgggaattatcattagtgaatatataaaacataaattaagtaaagttcaatatatcgaatggcagcacttgatcatcattattgagatcatcattctagtagtaattgcttttcttcctaaaaatgtcccaaatctaatttgtaatgttacaatcggtttagtttgttctttacaagtaaatgcttttaagaccacaaacggcctaccttatgcatcaactatgtgtacaggtaatttaagatccgcgggacaaaaattagcttcttatttatttaaagacgataaagatgctttaagtcattgttttcgttatttgatcatcattgcttcttttatttcaggtgccattattgcaactattttagttagtatttttgatcatatggctttattattttgctgtcttattctaattatcattttacttattttagtttattagcctattgattaggctctttttttattttaataaatgctcttctacataatcgataatttcctgacgattacttaaaacttcacaaaacggttttcttaaatctaaacgctgcatatccacacaacgaatctcacttaattgtaaacgactctttgttttggtttttgacatcattacatcaatatcaagttcaaattccggattacagctagttcctttcaacgaagtacagggaatgatcaacattttataccctaaatctttaagtacataacaccaatgtccatccattagttctttaggaaaaccacggccgatattgaaataagccaactgatgaattttaggtcgacaaggtaaatgataatatgtactgtcaatatcacgacccccatctttaactaagtgacagtaaaaatattctaactgatttgttaaatgttttaacgaacagctgtatttttctacatcataaatgcctgtttcttcaaggttttctaatgatttactgatttcagctaaattatcatgaatactcatattttttatcctcctattatcttttacatcactaattgtaaaattacttttattttttactgattttatttttttattcattattacaacaattttttaatttttttattttggtaacgttttcagcaaaaaaacatataataatttaggttgcttttttatttctatttgtatataatagcaactgttattaaggagacaagtaaaaaatagcgccaggactaattcaattagttgacgaggactaggtttatcgaaatattcggcgggtgacctagaggtatgatactacctaaacaatgaacaaaaataatgagtgatcattaaacaaattcattcggtatcctccattaataacataataaaaattaaatattatggaggaattttttatgtgcggaattactgcgttttcaggtaaagaagaagctttaccattcttattacaaggacttcacaagctggagtatcgtggttacgactcagctggagtgactcttgttgataaagataaactattcacgatcaaagctaaaggaagacttcaaaatctagttgatcgtttagatcaagctgtccctagcggctgtgtgggaattggtcatactcgctgggcaactcatggggtcccatcaaatcttaattctcatcctcatactaataatgacaacactatttctttagtgcataatggaattattgaaaattatcgtgagttaaaagaaaaattaattgctaaaggctatacttttcatagtgaaactgatagtgaagtcgttgttcatttattagattcttattatcaaggagatatgcttgaggctttaagaaaagtaatcgatcgaattgaaggcagctatgctctttgtattgtttcaactttagaaccagatacgatttatgtaaccaaaaaagacagtcctttagttttaggaataaatgacgaagccagctttggagcaagtgatattcctgcgttattggactatactaaagatgtttatttcatcgaagattatgaaattgcgaaattatgtaaaaataaaatcactttttatgatcatcaaggtaacacgatcaataaaaagactactcatatcccatatgataatgaagcagcgcaaaaaggtggttatgatacttttatgttaaaagaaattcatgaacagccttatgctatcagtgaaactcttagaggacgtgttgaaggtgaagatcaaatcattctacctgaacttgatagtttaaaagatcgttttgcaacttttaataaggtatacttcgttgcctgcggtaccgcttatcatgcgtgtttatcaggagctaatattttagaaagacttactggtattccaacttttacccaggccgcctctgaatttagatatggtgatccgatcattgatgaaaagactttatgtatctttgtttctcaatcaggagaaactgctgatacaatggcagctttaagattagctaaagaaaaaaaggcaacgactcttgcaattgcaaatgtccttggttcaagtatttctagagaagctgaagccactatttatacttgcgccggaccagagattgctgttgccagtactaaagcttatacaacccaagtaattgttttactattacttgcaatctatattgctcaaagtttaggtaaagaggacgaaatttataaagaccttattaaaggaattgctaaattacctcaacaaatcgaagatattttaaaagatgaaaagatttttgaaaattatgctaattatttaaaagatcagcatgatgcttattatatcggacgtagtttagattatgcttctgttttagaaggggcattaaaattaaaagaagtttcttatatccatgccgatgcttatattgctggagaattgaaacatggtccaattgcattaattgaaaatggcagtgtcgttattgctgttgcaacacaaccgcatattgctgctaaaacgatcagcaatattcaagaaacgattgctcgtggagcgaaagttatcttatttaccttagaaggtgaagaagtcggtaatgttaatgaaacttattatatgcctaatgtaaatccgattcttcaagctgtgttagtagctattcccttacaattgattggctattatgctgcaaaaattaaaggatgcgatgtcgataaacctcgtaaccttgcaaaatcagttactgtagaataaaagaacgtgaaatcgcgttcttttattataatcgtctagttcattttctttctaatacatatcttaaattagaaaggagatgagaaaatggagtcatatgataaaaaacattgtaacgacaaatggtgcattgaagactgcaacaacattcactgtgttgatcaacgctgtgctttaactgcaattattcaatcagtagctatgatagaagcttctttatcttcaatcatttgtgttgaagcaatgaaattaaaaaaagctgtttgtttagctaatgatcttgattcattaattagaattaatgaatctgttcaagaaacacttgatgcaattagccaattagaagaatcattaaaacaaaaagctgtttatgcaattgaagctctaaacgaattatcaaataaaaaatagactattattaaaaacagtgtacaagcaaaaggaataagctcaatgtcttattcctttcatatttatatcaacatgtattcaaaaaagcacctttactttttatattttgtttcttttaaaattaattatatgtcaattctttaaaaatattataatttttattaggagttatattaaatagacttagcaatttatgatcatacaattcatcctgatgatattcaggaataaaaacataattatcatcaaaacgtttattttcataacttttgattgataaatattttatacaccgataatcatatttacgcttactagcaattgaagctgtaaccaattgaggaattacataatttgaactataagtactctttttattattaactttaatactacaagccatcaataacaatagctttaacattgccatttttatctctattaatgacatttttttaagatcttttaaaaagaatggtgttaaatcaaaacatttaaacggtcttttaacctcaaaatcaccaataaaaaaattttccgtaaaatcatctatattcaattccgccttaacaccttcaacactgctagctaaatataaacaaggaaatcctgagatactatatctttcattaccaacaagatttcttttatcaaaaggaatatgaaaaatttgtttcacaaatcttttggcatcaatcaaatcatgatcattgatgatccgacctcgatacaataaatcaactttactctctttttcaaattcatcagctaaagaatgatttaaatatttatttgaaaaaagaatattataaataatattactggcacttcgtatatcacctttttcataaatacgccatgcctttaaaatactatctcgtaaacgattaaatacttttaaataagcttcatcaaaaatgttgtcatatttgataataatcttccttagttgcaagctttttttcaaaaaagctcgataacactgataatcaaattcacattcaataattataaaattaccagcttttatttccttttctaacatctcaactatttccatcatcacttctccttttaaaaaagagattatttctcataatctcttaatataacttatctggataaatacctgcactaatcaattctttaatactgtcaattacagactgtttatcctcctgataagttacaccaaaccaattgtccagcgattttaaaacagtaacatccgctttttcttctttcaataaatctcctattattgtcggtaataaatactcagcttttatatcttcatcatctaattgagataaaaactctttaaattttcgttctaaaatctcaaaaatacctggttgtaatgcccacatattcattgatacaggcacttgtaaatcaatattgatcatattttcacccgcttttacaaatgcacaattattacctttttcaatattatgtgtttcaactatatcaattaaatgattatcttcattcacactgcagatacctctagttaccccaccattatcacttaaagtgttttttaaaataaaactcaccatggcaatttgttctttaccattacttacctgatcattaactaaataatcatatgcttctttatatgcctgtttaccataataatcatcagcattaattactagaaacggttctttaactacatccttacaacataaaatagcctgccctgttccccatggcttagttctattttttaatttttcttgataaacttcaggaatattatttaactcctgaaatacatactcaacatcgataacttgtttgattcttgagccgatcacccgatcaaattcttcttctaaatccttacggattacaaataccactttattaaaacctgcttcttttgcatcataaattgaataatccataataatttcatcatttggtcccactggtgctaattgctttatcccaccaccaaaacgactgccgatacctgctgccataataactaatgtaatattcttcatactttccctcatttcttagcgttatcgtattaattatatactataatatcttttttttctaggcaatgtagtaaattgccttaatttgtcataaaaaacagcgttgatacaaatactacttcctaatttaaactttattaattcttcaagaaattactttaatcaaacacatttaccctttcaacactatcttaaatttattcacatactaataaaatccttcttacttttttatcatttttactatatgcaatcatccttttaaaagcatattgtattttagtcttcataatattaataatttatattatactaattttataatagtttgttctattcaattaaaaccatcttgaatagaacaaatataatttacaatcttcgttatttttaataaagattttatcttaattatgtaacgatactaaaagaaaaggagtaattttaaatgacattcaaaaataaaaaaagtaataaaattttaattgctgggatgctgtggcttacagctttaagtgcctgctcttctatcgaatcctcaaataacaataatattgataaaaataatgtatcagtaaacgaatctctacaatccgattttactggtacatcactaggtaaatttactattaaagatatcaacggcaaacaatataatcaagatatgttcaaagattatgatttgacgatgatcaatatattcacaacctggtgttcgccttgtgttgcagaaattcctgacttagaaaaaatccatactaccatggctgaacaaaaagttaatgttgtaggagtagtattggatgtcttagatgaaaaaggcaatattattcaagaatatcttgaaaaagcacaatcattagctaaacaaaccggtgccacatatcctattttaatacctgattcaacttatatgaatgggcgattaataggcattgaagcaattccagaaagtttctttgtcgataaaaacggtaatatcgttggtgaaacttacagcggcagtcgtgattttgaagactggaaaaaattaatagaagataatttagctaatttaaagagggacgattaatgaggcgctttcgttcatgtgcaaacggtcttttaataactgttttaggactcataatgatgttattaggaatctatcgcggtgaagtagctgtattatttacaaaagcgataaatatttgtttggagtgtattggaattggataagaaaaatataaaaataaaagagtgggtacgacatcgaattcaaattttttggatgttactaactaatagttatttaattggttttattcaagggaaaatctataaaggaaaattaaaaaacttatgtgtcccaggcatgaattgttactcttgtccaggagcattaggagcttgtcccatcggttcccttcaagccgttattggaagctggaattttaagttttctttttatgtgattggtttccttttatttattggtggactagtaggtcgcttaatttgcggctggttatgtccttttggattgattcaggatctactgcataaaattcctttttacaaaaaaatagaaacatttcctggtgatcgtcttttgcgaaaatcaaagtacgttattcttgtgatttttgtaattctgctgccattatttttagtagatattttaggtcaaggcacgccttatttttgtaaattgatctgtccagtaggaactttagaaggcggaattccattagttttattaaacaaatcgatgcatagtgctcttagctggctatatgtctggaaaaattttcttttagcatcaataattattttatcaattatcatctatcgtccgttttgtaaatatctttgtccactaggtgccatctattctttgtttaattctgtttcaatctttaaatatcgcgtagataaagaaaaatgctgtcattgtaataactgtgctaaagtttgtaaaatgcaggtcgatcctgttaaaaatgctaattattttgaatgtattcgctgtggatcatgtaaaaaagcatgtccgactggtgcaattacttccggttatttaaaaagtgaatttgccaaaacaaataaaaactgtaataaaataaatatttaataattttaatataatgttataatgcagatgacctgatttattcaaaaactttaaatatataataggggtgaactaaatgaattataaaattcaggggaattatttaacattgatcattgatgaacagtttaccaataaaacagttagagaattactagactggttacatttatctaaaaaaactattcatttattaaaacaaaataaagaatattttttaaataatacctatgtaaatgaaaaccatcctctaaataaaaatgatctatttaaaataaaagcttttaatgaagaatatattgactatctccctcaagaatttcctttaaaaatagtttatgaagatgcttttattttgattgttgataaaccaataaacactactatatatccagaaacaaaaaaagaattaaatacattatgtaattatgtagctaactattatctagaaacaaatcaagccttaacgattcgccatatccatcgtcttgatcaagatactactggtctggtaatattttgcaagtgccctcttattcaaccactattagataatatgatggctaataaactaattaaaagaagttatcttgctgtttgtaacggtattatcgatcatgatattactattaataaaacaattgctcgtgatcgtcatcaaaataaaatgagaatttcaaaaagtggtcaaaaagctattacaaacataaaaattttagcttctaatcacaaaaaaaactatactgtttgtaaatgtgatttagaaacaggacgcaaacatcaaattcgtgttcacttagcttcgatcaatcatcctttattaagcgatcctttatatggatataaaagtaaatttatcaagcgtactgctttacatgcttataaattagaatttcttcatcctattactaatagcccaattattgtaaaggcaccactgcctcaagatatggaatttattagtaatcaaatagatttttcttctctttaatcaaaaaagatttgaaactaattttcaaatcttttatttatctaaatattttctacatttctttactgataatttctaaacctacctttaccgtagtaacctgatcaaataacttcaactcaatatacgcaatacgtttatgcctatttattttaacgattttaccatggtaatcaactaaaggtccactaataatattaacctcgtcaccaacaatataaccttttgatatttcaataatatgctcactcttcccaaatctaagcaatgcttttgcttcttcttcaagaatcggtaaaatattactgccatcatttcctaatacctttgttaaatcaggaacaagctttaattggttgaataatatatcaatatggtcagttatcataaagacgtaacctttaaataaaatctcttctacttcattccacttaccacgatattttttcattcgtttacacttaggaataaagcattcttcatatatttttggcgaaatcaatcgttgacaaatttctttgatcttctcctcttttccacttttaacctgaataacataccagttatcatacatgaaaatacctccatttgggcatactttaccagtccgtatattttataccgactttaaataatataatagattatctttaataacgcgacatcgcgacgattatttttgataatctttttttaaactttttctttagattttacttctggtacttttcttttaaatggttttttatatgtataagttggtaccagctcctgaataaatggtctgatattgtcaacttccttatatgcttcttcttttagatctactaatctttcaaagaaactttcttcatccatctcaattggtttcccaatatgaatcagattgttcggtgtctcttgtagtccctcttctttcattaacagctcttcatacagtttctcccctgggcgcagtcccgtatactcgatctttatatctacatctggttcaaatcctgacagcttgatcagattccttgccatgtctgctatctttactggttttcccatatctaagataaatatctcgccaccttttgcatatgcccctgcctgtagtactagtgacactgcttctggtatcgtcatgaaatatctgatgatatccggatgggttaccgttactggtccacctgctttgatctgttttttaaacagcggtattactgatccatttgatcccaagacatttccaaatcttactgctacaaactccgtctttgatttcttgttgaatgactgcacgatcatctcacagattcttttggtcgctcccatgacattcgttggatttacggctttatctgtcgaaataaggataaatcgtttcgttccatacttgtcagccactctggcggtattcaaagtcccaaagacattattctttaccgcttcatttggtgaatcctccatcaatggtacatgtttatgtgctgcggcatgatagacgatctcaggatggaatctttcaaacagactttccatgcgcttcgtatttcttaccgatgcaatcattacttctagatttaatttaggatatttatcttttagttctaattgaatatcataggcattgttttcataaatatcgacgatgatcagctgttttggtttgttggccgctatttgtctacagagctcacttccaatcgatccaccaccgccggttaccatgatcactttatctgttacatatcccatgatatcttctaaattgacttcgatcggatcacgtcctaataagtcctgaacttcgacttccttaaagtcactgatatggatatcgccatttagtaactgatagattcctggtaatcttttgatcttgcactttgtttctttacaaatatttaatacctttgctaattcttttttatcagctgaaggtattgctacgagaatctcttcgatctcatatttttcagctgcttcaatgatcttatctctcccgccataaataattgcgccatgaacatttcgcccgtgttttgaacgatcatcatcaataaagcacattacctgtttatagacttcctgagaattgatgatttcacgatataccttttcaccagcgagaccagcaccgatgatcataactttttctaaatcttttctttccttaacactgccaaagccaatcttgcttctttttaatctagctagacgataagtaaaacgattaccgcctaaaaacattgttaaaagaagaaaataaataaagtaacagcttcgaggcaaattattgccggtaatttcaagaaaacatgcattaacgatactgtcaacaaaagtcgccaacacaatatttttaagttcgataattgaggcaaactgccataagctgtgataaagtttaaaatagaaaaagactactataccgcaggcaatcattggtaaaagcatcactgttagattttctaaatactgattaggtattgggccattaaatctaagcaacagtgcgccatatcctgataaagtgatacataatgaatctaccagtatcaagataattcttctaaaatttaactgggatttttttgtctcatccattgaatcacaccctccccttttataataagtcaaaaaaataaataaaaaacattatatgacaaaatcaactctattattataaatttatagtaataaatcaagttattttttattatttcttatttttcaaagaaataatttagattattagatttttattattacagatgtccgaattagataaaaaaagtaattctttaacattttttgttgattaattcttgcaatttatctgttaataaagcataatactcctgaaacgtatttattaggaggacttatggataaaactgaattaaatgatgaggttcaaatagacttatcagaattatttaaattaataaaaaaacatcttaaactaattattatttttatgttaataggagtcattgttgctggttcttatacaaccttcatgatcgaaaaaaaatattcttctcaaggaacgattcttttaaaagcgcaagtagttgatggaacggttgattctacgcagttaaattctaataattccatgattgctaattatattaaattattgcaaggaaacaatatccaagataagattgctaaaaacttagatatttcgactggtctagttcgcggtgctttacaaatttctaatactgaagacacccagatcattgaaattggggcaatcactactgatcctgggctatctaaacgaattgtagatgaaacgatcagtgtatttacagaaacagtaaaggaaatgttagatatctccaatattatcattgttgataatgctgagatcaacacaagtcctgtttccccaagtattaaaaagaatatgatgttaggagcggttgctggcgttgtaatatctttaggatatatcttattagcatatttattagatagtaaaattaaaaacggtgaaactgcagaacaagttttggatctaccagtattaggtgtcattccatattttgaggatcaataatggaatttattgatatacatagtcattatgcttgggatattgacgatggaatcagcagtcttgaagatgccaaaactgctttagcaaaagcacaagcacaaggtatcaaacaaatagtagttacaccacatattattcctgaaacaactactaatctttgtttaatcaaacaacgaatcaaagaatttattgaattagctaaaaattatggaattcaaggatactatggcagtgaagtaatgcttaacagtgattatttaactggtctaaaaaataacttattaatacctttgaataatggtccttatctattagtagaattcaatctttctcaaggtatcaatgaagaaagtgatgatcgcctttatgaatattctctaaaatataaattagtaattgctcatgttgaaagatacttttataataaattggatttacaaatgatccaatcatggatcgataatggctatatcatccaagtaaatagttcaagctttttgggtgaaaatggtaaacatataaaaaataatgcctataaactattagaaaaaggtcttattcatgttatcgccaatgatacccatcgaagcagtgatcgtagatgtccaaatttaaaagatacttatgaattattaataaaaaaatattcacagaaccaaataaagcagttaatgtatgataatccgcttgctattattaatggaaaaactgttttgcctgtgaaagttacaaaaataccctggtttaaaaggagaaaataaatgttcaagaaaaaaacaaaacatgaaaacaaatcaacgttattaataacaaatcctaaacaaaaaaataataaaatagattataaagaaatttaccgtcatattcgtacaaacattgaatattcaactgttggacaggatattaaagcaattaatcttacatctgctgtaccaactgaatcaaaaagtactacagcattaaatttagcgatgatctatgctacaaagtatcctaatattttactgattgatgctgatttaagaaaacctgtacagcataaatatttaaatatctcaaacagcagtggtcttactaatgcattgatcgattatggaaaaacaaaagaaatcaatcaatcatgttttcaaaaaataaaagacaaatcatttgttggtgatctgactgttttaacttctggggtaaaggttcctaatccttcagagttattaagtaatccggtttttgaagaattcattaaaaccttgaagcaaagttatgatttcattattgttgattgtccaccagtaatgttagtcagtgatgccattcctgttggtaatgtagttgatggcacgatcttcgtatgttcatctaaatctacaaatcgcaaagatgctaaagcagccgttgaagttttacaaaaaaataatgtaaatattttagggacagttttaactcaaattgaaaacgatggtacaaattctggatattactattattactactattaatgattgagcaaaagaaaaataatcttatttttgccatcgttgtcattgctctatgtgctttaactgctttaatatttatttatgatcgtaataaaacacaaaactttgcaaatcaatttactgataatggaactagtgagacagctaatcttgaagaaaatgaaagtaatcaaacaacaacaaaaaaagtagattcaacttcaactgatatcccgactttatattgtgttggtgatagtactactttaggtgttgaaaatcaaaataacgcttatccaacttatatagataatcttgctaattttaatatcaaattaattggtgataaaaatataacaagtgccggtttgttagtaaaattaggagttactcctgtctatgttgataaattaacgataccggcttcaactacacctacaccaatcgtctttttgaatcaaggtggtaaagctaataatgatcttttaaaaagtcaaggttcaatcgatagtgttacaataaacggtattactggtaaaattacctatcgttatgaaggtaacacattattatttactcgagatcaacctggtgaagaagtaactgttaattcaccaacgttgattcaagttaataataatatcgaacctgatggtattttagttctttatagtggtgcttatgaaaaaagtgttaaaggaagtttagttgaataccaaaaacaaatcatcagtgcttttaataccgataaatatatcgttgtatcattgactcaagatgatcgtaatgaaactaatgaatctttaaaaactgctttcggtgaacattatctagattttaaaagttatttgttagatgatggtttaaaagatgctggaataaccgctactgaacaggatctacaaaatatctctgataataagattcctgccagtctccgagctaatgatataaacggtaatgataaatacagtgagttattagctcaacaaattttaaatgaattaattgatttaaaatatattaacaaaaatattttaaagtaatttgtgaaattacttgtcatttgaaaaaaaaaaggatattatagatatgtatatacgcaaactcaaaaaggaggaagaaggaaatatgaagaaaatcatcagttcactacttgtggcttgtcttcttgctatttcaactatatcacctacacatgcagtaggatatttaaatgataacgaaaaagagcttttaactgctttaaattctacagtaaaagtagatggcgttacacttaaattacaagctgctgatattaatacagcagaaaattatatgatgcaagatggattcgatttaacaactgagcaaaaaaatattattattaacaatattgaagctactaaagcttatttacaagctaatcatattacaaatttcgatgcgatcacaagaaaacaagcatatgatattttagagtttcttcaagcagctggaggtgcaattggtttaacagtcacattaaatgctgctgatagaacaattctattttatgatggtgataaactaatttatactacaactcaggttatcaaaaaaactggttatgatataactcaaactgtagttattgcatcaggtttagttgttattttattaggtgcaggatattatgctaagaagaaacgtttgttttctaaataatgaaattaaatcataaacaacgtaaagtgatggcactaattttagtgccattatcttttacgcttctttgttatttaacattatatttattaataagtcctgtaattgagccattaatgtctatctatagcttaatttcaagtgattatgcacctactttaaatgatgaaaattctaaagatttatatgcaaataaattagtagcttcagatacaatcaatgcatctcaaatagttcagccaacttatggtgatctatttggaaaattaaccattgattctgtaaatattaaagtaaatctatattatggagatggtagagaccagcttcgtaatggtgtagggctatttgggggatcttttttacctggttttaatcgaacaatcttgattgcaggtcattcaattccatattttgaacctttaggcgatattaaaattggcgacataattaaaatttctacacactatggagattttgagtataaaattactaatactaaaatttctgatgctaatgatagcagcaattatgatcttgaacaaaatgatcaagaacaattaattttatatacatgttatccatttgaaataattggttataaatcacagcgattatttgtttatgctgataaaataagtggacctactatagtggagggacagtaagatgagtagaaaaagcagtcgtaatcatttatcatatttattagctttattattgactatatttattagtatttttattgttctaacggttactaatgtaacgatcatgaattctagttatttaatttctaaaatggaaagtgctgatttttatcgacaatctattattaatttaaataaacaaattcaacaagagacacagtctaccggatttcctttagaaatgtttgaaaattatgttgatgaagaatcggcagatgaaataatgaaaaaatatattgaaaatgctttttcaacaggaaataccgatattgatactacgacatttgaaacaaaactaactgaagatattgatgaatatcttcaatcagctaatattattattaatagtgaagaagaaacagctattgcaacactaaaaggcaatttgattagttattatcaaacctatttgacaattccttatttaaatttaataattaatcttattaacacatataatacatattactattttattgcaattattttaattttgttgattttaataaccagctttattttatatcatttacatagtcattatcgtactagaagaagatattttgcttatgctctatcaagtacaggattaatatgtctgattcttcccgcatttatctattttggtaattttgttgatagaataagcttatcaccacaatatttctatgattttgttacatctacaattagcagttatttattaatatatattattattggtattgttatgatcgttatcggtaatataactgcatatttaaggtttaaaaaaagacattaatctagggactttccctagattattttttatcaaaagaaaaagatgctcttcaaagcatcttaaaattattttcttaatcctaagctttcacataaagcagaatatctttcgatatctttattttttaaatattttaataaatctcttctacgtccaactttttttaataaacctctatttgaatgtttatcttttggatgttgtttaaaatgcccatttaatttgttgatatcagcagttaatactgcgatttgtacttctggagaacctgtatctccttctttagtagcatatttttgcataattgctgttttttcttctttagttaacatcgtttatttcctccattaatttaacttagctaaccccaagctatacgtcgagtattcgtatatcctagctgttgccgcaatcattattttaccaaatatcatgctaaagtcaagtaaattttcttttttcacggataaaaatataattttgagaatctgatttttctaaacaaaaacgatatcctaaaccattaaaatgctttattgaatcaaaagtagtaatacgatttttcacgatataacgaaccatttcacctcgagcttgttttacatatacaccaatttctttatattcatcatttactttctccataaaatagcattttacatatcttacatcatcatctaaatattttcttaatattctagtatattgttttgcgcctaaatcaagaatttctttatcatctttaattaattcaagatacatcttattaccccaaaattcataaagattacgatatttaccaaaagataacttattatttaattctaaacgatatgggacgaccccatcaaatggtcttaagacaccataaaaacctgaaagaatacggatatatttgttggaaaactcataatcttcaatagtaaaaatatgggcagctaaattatcatactgaatcccttcatatgataagattgcgggaaccgtatttttctttaagtcaattttttggtaattagtatatgcttcaaatgcaatcttatcactacattttaatagctgtttaacttttgaaactgacaatttttttaactctttcaataaaatttctgtatcttttaaaaatactggactgcttttggcttcaagataagtgatatcatctttcattcttttagctggtgttattattactttcattttatcactcgtaatgttcatttaaataatatctaactttattttgtgttttatttttatactctatagcttgcataggacatgatccaatgcaggccatgcattgtgtacaatgatttgaccacttaggtttttcttcacttatttcgatattatttaaaggacatatttttttacagttaccacagccagtacaatttttattaacataaaagccatcagcttttacaaatatcgcataaaataacttatttataagagaactacttataatatcaccaaaatgatatttatctttttcaaatttcatttcttttttaattattttaccaagttgtaaagttggctcgatagccctagttataatctttttaccttcacttggttctggcgatttgaacatcgtaatgaaattttctggcattattactgcttttattcccataaattctaaattctttttttgaacaagcctttttacatatcttttcgcattaccaattccacctccacaagttaaaataaaatatatttttttatttccttcaaaatttgtctttttaataaagctttcaacgattctaggtatttgccatgcatatgtaggacaaataataacatatggttttttactagtaaaagaatattttttctttgtttttaaacaatcatttattgaaataatttcatctttaatttctgaattaagtacttcactaagatatctgctattgcctgttccactaaaatataaaatcattgatctatctcctatatatgataattactgttataatattaaaaagttcaaagatttaatttgaactttatttccataaataatttaaataaacaacattttctttttgccatgaattttcattgtgctcaccattttctactacattaatataactgccagcattcaaactaagcaaataatcattaaaataagaaatatttttaagcatcttatcaacatctttgatttcttttgttccaaaactaaaataaaccctggtatcttcatcaattcgattatcttttaattcctgcttaagttcattcatgcatatagatattgctggtgaaatacaagcagctttagaaaaatactgattatgtctaattacagtatataaagccattaaaccacccattgaactacccgcaacaccagtgcattctctaaaaggataagtacgatatttatgatcaattagtggttttaattcatcgataagccacttcattaattgtttaccacgacccttgattggtccaaaatagcctttcttaatatcatatggacaatattcatttaaacgctcatggccttcatgattacattcaatacctactataattaatggcttatcataatgatccataaattcctttaagccccatgacttaccataagtcgcatcttcatcataaaataaattatgtccatcaaacatgtacataacaggatatctttcatcactataaaagtaactatctggtaaatagacgtgaatcgttctaaataaatcaaatggcgttattttaacatcaaatttctcaatcatcttcttctcctaataaccaaatatttctactgcttttttcatttttgtaataatatcaactgcaaatggacaatttttcatacaattaccacaagcaatacattcactagcatgatgttttagtgaagcataatgctcttttacagtttcaacaacttcaccctgagctatgcataagtccgtaaatttattaacatcacttatcgaaattttctttatacatggagcacagtgaccacaataaacacaattaccaaaaaaagaatgcttctcaacatttgcaagcacattagcaaaatccttttcttttaaagatgccttactataagcagctgcttcttgcatttgcgcaatcgtatgacttccagccataacagaaacaacaccaggtcttgttaaagcataatgaatacattgcaatggtgtcatctttaccttaaatggtgataatttttcatcaagcagatccccaccaccaaaagctttcattacagtaatagcaacttcttgactttgacataattcatatagctcttgacgaacaggatcgatatttatcaatggtttttcataattttcatcattccataaatcatcaacatcttcacttggcggtaacatatcataacaaggatttatagaaaataaaattacatcgatcaaacctgttttaacggctttgattgcaatattaggattatgggaactaattcctaaatattttattattccctgcttttttaagcttaacgcatacttaatgatttcaccattaaatacttcatcaaaatcactttgtgcatcaatataatgaatcatcccaatatcaatataatctgtctgaagtcttgtcaaaagatcattaaatccttcttttacttcatcaattttacgcgtccttaagtattgatcatttctccaaatagtacaaagatggccctcaattacccattgctcacgtttatctttaattgctttaccaaaagcactgcgaacatcaggatcagaagaataaaaatcaataaaattaataccttcctcatgcgctttttcaacgaattctttgatttctgcagtactttttttcataaaaccttcacagcctaacgctatttcactaacctttatcccagtttttcctaataaacggtatttcatagttaatcacctcggttttattttacatgttaaagcaaactttatgtcaagtaatattttataaacgatttattaaatattgcaattcatttacaaaacgacagagatgaaatccatcacacaaagcatgatgtacctgaatagctaaaggtaatatcaaactatcattttcttcataatatttccctattgtaaaaatcggcaataaacaatcctgcgttttctgtaaattaaaattgaaaccttcaaaagtaatccatggtatcgcaaagatattaaaagtattagctggcagatctggtttagcttctcttttatttacagatccaaaagcccgcatatctcgtttgtatagttcatagaaaacatcgtaatcttctgtatactcagtccaaacatttgaaaaagtttctgtttctttatgaaatattgtataatgaggaaacatataatcaaaaacccctaattggttatttgaattaaatgatgttctaaactcctcatgtctattaacgatattagtaatactgtgtaataacgttggatataatttttgttcagattctcttatttttgtaatatccaatttaactgtcattgtatatgtacaaggtacatttgaataataatgatcaaaatattcacttcttttccaattttctttgtcaataactttaaacttcatgtgcatcccccacaactttttattaataaaaataatctaattaaatatattataactaaaataaaatcgcttagataattttaatatctattttcctagcaatcaatctttgataaccataatagctaggaatcttgtatgaaatagtagatcaataaaaaaactattataatttcaactatcatcaaatgaaaattattactttttcaatcgttaacttttttatattttcatctactgattcataatttaatattctatatcacctgcttttttacatatttgccatagtctaaaaacctgctcaacagcattgatcatattttcgctagcagtctgctgatccattgcctctgataaagttgtcacatctcttaaaatgggaaaataagcatcaattccaagatcattgcatttttcagctccttttgctacagctccactaaaagcaataactggtaattgatattttttagctaatttagcgactccagctggtgcttttcccattgccgtttgataatccagtcgcccttcaccagtaattacaagatcagcatctttaatttcttcttctaatttaatttcacgtaaaatcaaatcgattcccgattctaatttagcatttagataagttaaaaaagcaaaacctaaaccacctgctgcgccactgcctggataacaagcatcagcttgaatgaatttttgtttcgataatacagcatagttatttaaccaaatatccatctctttgatcatttcttgatcagcacccttttgtaaaccatatacagcactagccccaaaaggtccgcataaaggattcgttacatcacaggcaatcataaatttgcattctttaattactggtaaaacaccactatcatcgattttttcaagctgctttaatcccttagcaccgaattcaacttgattcccccttttatctaacattccaaacccaagggcctgcaacattccaattccaccatcattagttgcactgccaccaattccaataatgaaatgacgacagccctgcttaattgcatcaatgattatttgaccaattccatatgtagtagtatttaaaggatttctttgttctttagtaatcaaagttaaaccagctattttagcaatttctataactgctgtatttttagcatcaattattccatatgagcattcaatcatattacctaaaggtcccattgcatttaatctgcgaattcttccattcattccttcaactaaagtttcaactgtaccttcaccgccatcagctaatggttttactaaaacttcactttgcagatatacacgtttgattccctgttcaattgccttgccagcttcaagtgaagtcaagctccctttaaatgaatcaatcgcaattacaactttcatttttttactccatttcaaaaaataattgattttcttttctcaaagaacacttttttgccatcaatttacctgccacttttaaaagtgccaagttaacctgtcgtgcttgattaggacaaacctttacacagcgcatacaggaaatacatttacttttatcaacctgcttaggattatccagtggtatagcctgtaaaggacatgatttagcacaaactccacaactattacataatctattcccttttggtttaaaaggaacaccatcatatttacggtacggataattaccaggaacttttaattctgcatatttttccttagtatcaaccaaattttttatttctctactaaaaacctgtaattccatttgatcaattgcatttggtctatcactggcaaactgattcataattgaatgtctagcaaccgcactaattgctgcaatcggattaaaaccattatcctttacggtattttttaattccaataaagtatcatcataatctcgattgccatatacaacaatcaaaattactctagtatgatctcctttaatatttgttaatctttttattactatttcaggaacccgacccccatatgaaggaatcgcaatcatacaaatatcgttacgatctaatacttttttttgattaaattgcggttgtgttaaatcaattaattctgcatcgatcttccattcattcatcaacatatctaaaacttttttagtcccaccagtgggactaaaataaattccatataatttcatcagtctatcaccttctattttttcatcctatagccacttataattataagctactattttttataatgcaataatactattaattcattgtatctttacaacttataaattaatgaaatagttacaacaaactctttaaatcacttatacttcaaaaatattaagggtacctagcattttaggtacccttatcataatataaatcatattcttataaatcaaatctttaaaattttcctccgcccccaccatgagtacgtcctgatgaactacgatgagtagtcgatccactacttttactacttggtctgctactgaccttgctagtagttttatgacttgatgttttagctccagaactatgataatcttgttttggctcttctttacgacgttttttaacatttgaaaacaagaatagatcatttgatttagttaaaacaaaactattttctttgatataattatttgcatcataaaccctctgttttgtttttagtttccgtaatttcaatctacccatcatataagcaatcacaaatccaataaggagtgatgccaacaggttttcaataagataatatttttggtgagaactttgattattttctgttgttacagtagttgaaactggctcacgataatttttagcatattcatcgacctgctctatgaaaatattaaaagcattataataattttcttctttaagatcagccagcatcgcatctcctaaagcttctattattgaatcagtataaattttgatggcttttccatgagtagtaatgtaccattcacgttcactcatatctaaaactaaaagtaaaccatcgtaagtataaccaagtccataatcattttcatcataaaaatcatctgcaaaattttgaattaaaccgatatcatttgttgaataagttgttacgattgcaacatctagactataagttgtaattatattactgatttttaaaaccagatctgtaacttcttcatccgtcaaaagattcgccatatcaacaacacttttacaactatctctaccttcaatatttagtcggactaaatgtaaaatttgttgaattgaataagtttctttatatctgccacttacatgaaagtaagggctaaaatccattgttagatcaagatattctttagcttttccataagtattaatatattgggttccataaaaaccaccagattgattgacagcaataacaataccatcactgtcaccatagtgatcatagtaatattgatttgcataactagataaatcaaatccttcatcatcattatcaatatatatgattggtatattaagattatatttatcatgaaaactattagttagagtttctaaaacatttaaacaattagtattaaaataattattgggatcataaacataattttcttgggcttgtacaggaataattggtaagcagataactaataggatcaataaaatcgtttttatttttttcatttttaccactataaattatatataacaaaaattaccaaagtaataataatggtgtttcttgctactactttccaaaattcttttttatccgctggtaaatcaccaattaatttacctgtttgtccattcatcattaaaggatagatcttatcatcccaagataagtttaagatccacactggcaaaaagtaataggttatctttttattttttaattcaatactggaattttctaatattttatgatcatatccactaatacaatttttaaaaatcgtattcgtactatttctaattcgactattagctttactttcactgactttactgttttcatcatatcgatcagcaagataaccagctaaatatgcgctatcaaaatcaactgcttcattaaaatcaaatggttcaatcgactgcataaactcatcatcaatcttagatgaaccatctactggaacattattaaattcgatgttcccttcacgaatcaatgaataatacttagtttctgtataatcatatctactatcactataatgtcttgttttagttgctcgatattgttgttttacatctgctgtgcaattatagatccaaaaaggaacataaattccttttatctcatctaatgtgctgtttgttttaaatgttttaggtaaaaagggtttacctttaaaaaactcttgtaatttagctttagcatcttctttatctaatttaaaaggaataacataatcaggctttaactgattactaacatttttattcataattacaggactattacaatatggacatgtagtagcaactgtttgactatttccaatgatttctccaccacagttttcacatgaatagacacttatactgtcatcactaaaaacatcatggtccgctatctcatcccaagccatttcatcttctttgatctcttgatattgtttctgatattcttttagtgttgcaatctcaaagacagaatcacaatatggacaagctaatttttgtttatcactatcaaatttgatttctccaccacaattagggcatcggtatactatcatcgtctccatagcttagctccactatcttttatcattatcatcaaaaacatcaccgcattcaggacaaaattttgggggatgacgaggatcttcgggctcccagccacacttatcacaacgatataatggttcatctaatggtttcggttttccacattcactacaaaattttcctttattaatatttccacacttacagacccagccaactattttaggtttgccgcattcaatgcaaaatttaccaatattttttgttttgcatgaacatatccattcttctttagctttttcctgctgtttttgtgacatttcatataaattttgggtatttagattgtcaacattttgaaccatattcattcccatgaacccaagcattgctccgccatcattatctgctgctttttttaaagcttcgctttgggcttcaacaagagttgctgcagccattgaaggattctttaaaattgccgttcgttgtgcctttttaattaactcttcatcttctttattagcaacaacagaattaattgctaatgaaacaattttaattccccgtaactgttgccatttttcacttaaaatctcatttaaagcatctacaatttcaattgtatgtccaggcagtctactgtaacggattccaatatcagaaattcttgcaaaagctggctgtaatgctgtcagcagttctcctttcaaagtactgtcgatttcttcacgtttaaattcacttcttacattaccacagacattaacgtaaaaaagtaaagggtcaacgattttataagaataagttccatgacagcgaatcgaaatatcaatatctaaaccaatattagcatcaactactctaaaaggaattggatttgccgtaccatatttattatcaattatttcttttaaattaatataataaattctttggtctctacctgtgtctccgccataagtaatccttttgatcacagttccaaatgtttccatcacagaatcacctaaattaccagtaaatatacttggttctgttgaactatcaaaagtaaattcaccaggctctgcacacatttcaacaattttcccctgctggacaataatcatgcactgtccatcagatacagcaattccactgcctctagaaatgatgttatcatcacctttactattagacgaacgactagacgttcttttcactccttttgtaactaatacatctttatccattgcttcacaataaaaaaactctttccattgatcagctaaagttcctcccacagaaccacttatcgctttaattaagcccatatttttctcctttcaatcccctatttaacaactctagaatataagctgggttatctatttcttcattaaaaacactattctagaggacaaaatcaacaccagtattaacttgataataacttaatgaattaccaataaaaattacctcatcaggtttaatttccattttttattatccattatcgagtaataactaaattacttagttatcccttaaattataacttatttctaaatatttatctattatacaatcgcattgaacctaacagtttataaattattatctaaaattctttaataatatattagtaaatgtcataaatataattttattaactaatacaattttttcaccatagtatttctctaacctaattttcttttttaatctcatcttattatattaatattatgaatatcttctattttacatatatgtctcttggttttctgatcataactgattgttattcggtgaattattttaattaaaataacagctatttagtcaaacaaaaataataaacatagaaaaatagttaaaataatttgataaaatgataggcaaattattttaactattttattattatataaaggagctgacatacaaaaaaagaaagggtcattggatcgggttcttactcgcttatgggtaaatgaacttattagacagcacaagaaattgtgctgtttttgtgttctaaaatatcaattagcttaaaatctttattattcattaaaaatggtatgtaacatttcctaaaaagattgactattttgcttcttccatataaaatacgtttgatgagtttgaatgttattcggtgaattattttaattaaaataacagctatttagtcaaacaaaaataataaacctagaaaaatagttaaaataatttgataaaatgataggcaaattattttaactattttattattatataaaggagctgacatacaaaaaaagaaagggtcattggatcgccctcctgcctttctttttctaaaataaaacgtatgctttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcgctgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaatagtgaaaaaatagcctgttatatgaacagtattattgatggattgacgatagcaaaaggattaagtataataagcgctcatatagcacaataccaggcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacagtttgaatttgttgttgtttccttcaacaaatccagaactatatggataagatattgcgttcttgatcggggcaatatctttttctataccttctataaatccttttaatactgattctctataattatcaataaacttatctagctgatcagtatctgcctccttgatcgtgctgtaaaacgaatcatatattttttctagttcagttataattggatatctttccttgattatttgaatgtttttttcaactgttttatttttctttgttttctcatttttagttgttatgtattttaatatttcatttctttttatgatgatgatattatctggatatttatacttaatataccaccccattgaaagagaaatactaaaattattttttaataagtatacaattctgttatccaatgacttccacgtacctttatatcctttcataatgacatagctaaagattatttctggctttattccatccaggatcattttatagatcatattgatatagtcatctgtagctgtttttctttgtttgtatttctttggactgtctaacaattgaatatcctcttcactcatatttacatattttttagctacaatatttgatattgaaaattctttagctattgttgtgtatttctttttttcgagttcctcccatcttttttgaatgtcaatgatcattttctgttttttttacggctttcagcctgctgtctgtgttgtttatcgtttttatcataacataccgcatcaaaatcaatcatatttccttctttatcaactggcatactgttgtcatagtcatatttttcaagttcctttgaatttggatcgatttttaatgctggaaccttttgaggttcctcttccagtacctttccatcttttatgaatactgtttccggtatttccgttttaaaaatatcttttattctgtcaattaaattttgaagaagatgaaatctgtctgcaatctggatacattcaggtaaaacttcactgattgcagaagcgtatgcacttgctctgtcacgtgtggcaatctttattttttgatgattttttagccattcaacaactgtttccttatctcttccatctaaaagcgcaataagatgatgatcttccatatcatatatggcagttgcataagcctttccttttctcatcgccacatcatctattccaatagactcgacatcagggtcatcttcaataatgatcttatcagtcaggcgtttgatagagtcattgcttatattgaccccaagaagtttcagtactttactggcaccttcattgcttaaaaagagagaaactgcaaggataagacagttaagctcatctgttcttctttgagagggagaaacaaaaggaagattctgcataataacctttctattgcatttgtcattagtacagtcatatttataagcaatcacatcaataaaagttgttttatttctaacaggataagcctgaatcattctatgataggtattatgtaaagaacttgtaggagaaccacacacaggacatacatcatcatgagaagtcgctttcacatatattatgattttattatctgattctttccagtcatagacaatgaagtcattaccaaagattttttcattcaaactgatttcattatatttcatatgtatcaccatccatacatatattgtatcaaaatgcccaaaaacaagaaatacaaactaaagaaaaacagcacaatttcttgtgctgtctaataagttcatttacccataagcgagtaagaaccttggatcgccctcctgcctttctttttctaaaataaaacgtatgctttacaatctatatgctatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcaagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcgctgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaacagtgaaaaaatagcctgttatatgaacagtattattgatggattgacgatagcaaaaggattaagtataataagcgctcatatagcacaataccaagcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacaactgattcctactaatagtaaattatctttatacccttccaatccctttggatatttcttttctttgatttgatctatcgctgtttctgcttcatgatcccattttaactctactatcatcgctggtttatcatctttaggaataaataccatatccgcatagcctttcccacttggcatctctcttattatcgtataatgatttcttgcatatatatacgctatcgaaattgtataggataacgcattttcattattatatgttagtatcgctgtatccaaatgcgcttcttcgatatacttagctactaattcttcatctctattccatgttgcttctaataaggctctgctgtttaataacgccttcgttgtttcattccatgatgaatcttcaatcgatgctataaatgaactcgttacttccttatttggtatataacatgtctgattggaactgttatatcctagataacctagatgtatcagcagtgtcaagacatcatcttttgatttgaacgtcgtcatatcattttgaaacttatctgtattcaaatatacctcttctccggccaataacttgacaacataatctttcaagccgtcataattcatatcgatatacactcttaaagcttcatacgtctcggttgatgtccaataattcccaaactttttccttgtaatcgatgctacaactgatcttggcgaaaatgttgatatcgtatctgtcaaatgataaccatcataccattctttcatttcatcatagctgatattatactgacaacaaagtttttcaacttccttttctgtaaagcccatatattctgataacaatcctgaatcaaccattgaaatttcatcaaacatattcaaggcactatgggttccatatttcttgatcggtaagattcccgtcatatagaccagttcgacatatggctgttctttgaataacagtcttaaataatccagatatttttcctgagcttctttatcctctttatattctctaaagatacagtcccattcatcaatgataaaaataaaactttcattagtgtaagcaaatatttgtgataatactcttgataagacatcttttcttataaatttaatatctccatattcttcaattagttcaaataaaattgattcatttatatctttgatcatttcctgaatagaatcattaacacttaaaaacttttgaatatcgagatgaatcacattatgtttatttatatgcttttgatataattctgtttgacttatttttaaatcattgaatatatccgatgaatcacaacctttggaataataagccactaacatattggcatcggtgctctttccaaatcttcttggtctcgatacacaaatatatttatttactttttttcttaaatattcgaccctttcaatcaataaagatttgtccacatatatttctttattaaccgcttcataaaaattctgattatttggatttaaatatattcccatacttatcatccctttctttaggtaataattataccataaataatcttagttttatcaatataatctaagtaataaaaataaaatttacacaatatctttatataaaaaaactgactatatttttttgtcagtttttaattataatatttattttttaacgagtaatttcaattctttatctgttaaactccgatactcaccataatttaaatcttcatctaattttatccctgcaaatgcaattctttttagactaattacctgattattacaagataaaaacatcttttttatttgatggtattttccttcactaatcgtaacaaaacaatgatgattatctataatttctaattttgcaggcaaacatttaatatcttgatcaattataattccatttttaaaaagttcaattaaattattatttagtatttctttagtttttactaagtattttttttcgatgtgattttgtggtaaaagtaatttttttgaaagagttggatcattggttataaccaacaatcctgttgtatctttatctaacctgcctaaacaataacattctttattatcaattaaatcaataacacatttttctttaatatcttgattagcacaaatatatccaacgggtttattcatcatatagtaactaaaaggctgtgcttttaacatgacattattatagattattttatcatctttgtttactaaatacttagtattagtaatgatttcatcatttactttaatcattccatgtttaatcaaggttttacatttttttacgttgcctaatttgtttttcattaaaacataatataattccttaatacaatttccccctaaatgcgatttacaccatcttcaactgcagccttttttacagcttcgcttacagcctttttaactcgagagtcaaaaattgatggtaaaacattatcggctgataattctttttcatctaatatttcagcaatcgcataagctgctgcaattttcatatgttctgtaatctgtgatgcttgaacatctaatgcacctctaaacacccctggaaaaactagtacgttattaacctgatttggataatcactgcgccctgtgcaaacaatcatagctccagcttctttagctttttcaggcaaaatttcaggaactggatttgccagtgcaaaaataataggttttgaattcattgttttaatcatctcaccttgaagacaattagcaacactcgttccgataaaaacatcagcatctactaatgcttcttttaaaccacctttaattttacgaggattagttatcttagctaactcttctttttgaccttctaatccagcttctcttcctaaagataaaataccatgttcatcaacagcaataatatctttaacacctaatgcctgtaacattttaataattgctgttcccgcagcacccggtccgttttggactacttttatctcttctattttcttaccagttagttttaaagcatttattaatgcggcactaacaacaattgctgtaccatgttgatcatcatgaaatacaggaatatcacaaagttcttttaaccgatcttctatttcaaagcaccgcggtgcactgatatcttctaaatttattcccccaaaacttcccgataataaagtaatagttttaacaatttcatctacatctttacttctaatacataatggaaaagcatctacatcaccaaattctttaaataaaatacattttccttccataaccggcatccctgcttcaggaccaatatctcctaatcctaataccgcactgccatctgtaataactgcaaccgtattccagcgacgtgttaatgtaaaacttttgctaatatcttttttgatttctaagcatggctgtgctacgccaggagtatacgccaatgctagatcatctttgttctttaatgtcacacgtgatttaatttctaatttaccgcttaatttctcatgtaaatttaatgcttcttgtttataatccattctaattccttctttccgctttttattataccgctgtttttgttgaaattaaaccatattcaaaaagctttttataaaaatatttaatatctatcaatatataattatttactaaaataacatatgaagataatcttttttatctatctataagttggaatatcccatatttatggacttttttacttttcaatagattgacaccacaagtctcattctttcatgaaaagttgtaaaaatgcagtaatttcagctcttactactatactttccgtaccatattgtaggtgtgatttgttgcagattttaagaaaaattttctagtatcaaaaagcccacacaaaacataatgtttgtatgagcaaaaacacttgtatatttagttgtaatagacaaagtgctcttatgtccttgaatactgattaaaacacagcatatatttgacttgcttttaaaaaatttcctttatctacaattatttactatctagatttttcaaaaatgccaaagatatcttcaacaaatattgtatcattcattttcatctcaacatattgattgaaattatttttatcaatctgtgtcccttgtatcacttttttccaattaggataattttgttcaaaagtatttcttgtaatatgataagtacttccgctaaaattgaaattgatatattgcacattttctattaaggcaaaaatggatgctgaattataaatcatgctcttttccacatatagattatcgtttctgtaccaatcggtaaaatgataatcgattatcaatccgcaatcttgtgaattgatttcaaatacatatccatattcagagagtggcaaattttcaattaaccttcctgcattactattatcgccaatatatttactttgatatttaagaatattgtctattccacttttttctctatcaaaaggacttattggaacagtatcaatcgtatattcctttttgatatcaatcacaaagtattcattaggagtatcagcgttgatttgatatacatggtaaaaaggatttttgtgtaaaatcactttgttttcagcaaatgttgtttctgttaggtatctataaatcggtggtcgttttgatgtactgacaccaataaagtctattacaaaaaaggctgataatatcagtaagaacaagcaaacacagatcaacagtttttttcgtattgttggtactttcaattctctaaaaatacctgcaataaatagtataagaccaataattgaataaatcgaactccaactactttctggtgagcttataataaaagcacaaaaacataaacatattccaatcaccataataaaaacagaaatttttttatgttcatttttgattttctcagtactataatctaacgtgctgattatatttttctctgaatattcaattgctccatctgcttctattgtttctccagcaagtaattcatttaaagtaatacctagttccttgctcaatggttctaataaagaaaggtcgggcatataatttccattttcccaacgagagattgttttgttactaactcctaacttttcaccaagttgttcttgtgtaagtcctttggctttacggttcaacgcaataaatgctcctatttttttagtatccatacattttcactcctttcaagacaaatgtaacagattttaccgtaaaatgaacaccccacaaatagcgaattgcttttttttatcgatattttagtcttttttgtaattatacagatatcataagggggttgtttcctaaatatcttttaaatcgactattgctgggctcgaatatgtttaaaaagtggtataatatatttcttatctatccaatcacatgcctgtccctgaacacataataactctttcatccacgttttacatgaggcagtatcttgttttgaaatcattttttgtaacattttacacaaagtgcgatctttaaaagtcatactcctttcattccatgcaccccttgcatagaacaaaggaatgttttttaaatcaccttttaaattacgtgttttaacttcttcaatagcttcttcatcaaaaggagaagctcccacacataaaataatgatttttttgtgccttaaatttttatagtttttacgcaaaatatctaatcctgctattccccctacatatattgctccagcaaatataatccaatcatatctttcaaacagcacctttttatagttcgtaatttcaaaaatatcacagcataattcctcttttaacatagcagcatatttctttgttgccccatactttgatttgtaaagaactaacactttattcatactcattctcctggtatattataaatgactcatttaattagtcatctgcagtataccttttcctttctgttatgaagtgacctttgtcaagtgaaaattacacattcataataaaattatttaattttatcatcaatggcatacaaaagccccaaaatactagatttatcgacagttaaccactctgttatacggagattggctactccaaggttaatggttcgtcaaataagttctaactatctatatacgtgaatcatctataatttatgatattccagatcgcgacttcttttatatcttatttatgccacaaagaaaggaccgtagataactaaacctgcttctccttttttgaggcttttctatgccattgattttgtgttctttttttctcgatttttgtcctccatttcttattttttctttaaattttcataattgtatagaaaacatctttttacatcttctatattcttcctgtttccattccccatataaatcctgctagttcccttgccactgccatgatagctacattatatggtttccctcttaataccatccttctaaatcttttttgtaatctttctactgccttatctgcatatgctacgatttcatcctcctgtcctttttgtctttttttcaacgcttttgatttctttccaactgttcctcttactaatgcctgtgtacattctaccagtgtctttctaaccatcgcattccccatcttggtgattggtgtattgctgtatttctccgcgctcgaattctctcctggaagcattcccagattcgccataaatgcctttgctgttggaaatcgctgaaaatcactcactgtgacatgtatcttcattgctgataatgtatctattcctttgaaacaggaaattttagaaaccggttccttatattcctcttcttttgaaaactcttctatcctttcatcatatttttcaatacgttcatttaaataatcatagacttttaaatattcatttaatgtttctcttacgattactggcaattctatcgtttcaagccatttgatatgggccactgtccagttgcttttcccctcatatcttaatcctcgtctcaataccaatgcactgatctgctgtttgattctctttcttgactggatgacatcttctcttagacctatatattccttgatttcattgtcatgttctgttggtacatgaacagctttgtatgaatcgtgcataagattagtggcaatattaaaggcatccatcttatcattttttacttttttatttttgactgatccatgcattgttgatggtgctaatataacacatggaatatcatggtatgcaagttcatgatataaggaaaatcctaaacatccagcttcatatcctgttaaaatatccacctcattttcttcactcattctttctttagctgacttaataaatttaagaatattctttacttcagcagcacattttgtctgtgcaataacttctcctgttgatgaattgattccacataaactgtacgtatttttatggacatccatcccaatataaattatacttttcatagtgacctcctattgtcgttatggtatcgactttcataattttatttttttactaatcttattatgaatcgtaatccactttttgacaacttaggaggtcacttcatattatctatacttatttttaaaacaagcatatgaatgaaaaaagattatcctgacttcaatgaagattatagcatcaaaaagatatgatgagcatgataatcagtttgtgacactaaatatcaatgagtttaaagatgttattaatatctttaaaaattgggaaagagaaatcatcaattcattttattcccattaatagaaaaaggacctcaaataagccaattgaatctattaatggctgaattaagattctattaaaaataactttaaaatataaaaattttgaaagattaaaaaatcgtattatgtactaataccaatatttacaaatcaaataaagaaccagtaaggccagatactaattaaataaaataaatgtttgagcatattaaaagtatcattcttgaccccacggtattgaatgatactttttcaactataaacaaaagcgagatcaacaaaatcccatggaagtttagagacccaatatttacactgtctattaagcaattatctatcaatttacttatttatctgttactttataaatgcattacattatttaaaagtattgatctaactacattttaataacagaatattttctatatgcgttgtttggggaaacatatcaacaggctgacagatatcagcatgataaccaaatccctgcaaatacttaatatcacgagcttgagttgcaacatcacaagaaatataaactatttttttaggatgagcctgaatcaaataatctaaaaattcagccgagcatcctttacgtggtggatcaacaaaaacaacgtctaaatgctggtgattatttacaagttcaatcatatattttccagcatctgcacacttaaattcagtatttttaatattatttagacttgcattagttttagcatctttaatagctgcttcaacgatttctacaccataaacttttttaacatattttgctagtgaaagggtaattgttccaattccacaatacgcatctaaaacaatatcatcttttgataattctgcaaactcaatggctttttgatagagtttttctacttgaataggatttacttgataaaatgattttaatgaaattttatactgattatctaataatcgatcataaatataaccatcaccatataatataacttctttatctcctaaaataacattatcgattcgatggttgatattttgaattactgttttaatcatgggaaactctttagtaatcgctgttacaagtttatcaatgttgtttatttgatcaagataacttattaataccaacattacctcattagtatggtaaccatgcttcgttaatatatgtttgatatttccttgatgtgatagtttatcatacggataaatcttatattcttccattaattctttaactctttttgttatttgattagacaatttattttggatagaacattcgtcacaaggaataatttcatttgatttttgtttataaaaaccagttaccagcttgttgcctttgattcccactggcatttgaactttattacgataataccatggctcttccatcattaagcaatcatttactttaacataacagttaccaattctttctaaacaatctttaactcgtttagtcttaaatagcatttgcccttcttgatttaaatgctgtaattgacaaccgccacatggtttaaaaaccaaacatttaggctcttgacgatatttagaaactttatcaagctctattaatctagcaattgcataattcttcaatactttgattactttaagttttcctgtttcaccaactagcattcctttaacaaaatatgtaaagttatcgactttaacaacaccctgaccatcatgtgtcaaatcaacacattcaccataaaaataatcatttttcttcatcttttcctcctaaaaagacgagcatcgctcgtctattcggtttcatctttctttaaagcacgattagtagcactttcatcaaccatattagcacctgtaaaactgatttcatcactacttggatgcttagttccaaaaattgggaaatctgtatcaccattactagttaaaacaaattctacattatattgccctcgaccattagcagttcctaataattcactataggtactatcttcgcttttgggttgtcctaatgcatcatctaatgtatgtaaggcgttggtggctaattgtttagcatcatctgaagtaatattatcaacaaaattcattgaaatcttaataatccgacaatctacttcaatatcaatgctgttgatatttggatcagctttaatagtattttcaacatccgtaaatttatcttcgtcaatagatatcaacgatgcacaacgatcaccataaacaggaccatcattacctcctgctacgaacacatatacgataaagataattatcattaaaagtaataaaattaaagcaatccatcttttctttatttttctctttttcttgcgtttacccattggctttttttcaatatccttatcaatagaattagttaagggagttttctctatatttttaactgacttatcttcattttttaatgattgtaagtcttcttctaattcatcgtcaaatacaaatcttttttgagacatattcatatcctccttcaactattgtaccaaatatatagatatttgtacattaagaaattcttttctttaataattcaatcaataatttatttgtaagacccggattagcttgaccaccagttttcttcatgatctatacttatttttaaaacaagcatatgaatgaaaaaagattatcctgacttcaatgaagattatagcatcaaaaagatatgatgagcatgataatcagtttgtgacactaaatatcaatgagtttaaagatgttattaatatctttaaaaattgggaaagagaaatcatcaattcattttattcccattaatagaaaaaggacctcaaataagccaattgaatctattaatggctgaattaagattctattaaaaataactttaaaatataaaaattttgaaagattaaaaaatcgtattatgtactaataccaatatttacaaatcaaataaagaaccagtaaggccagatactaattaaataaaataaatgtttgagcatattaaaagtatcattcttgaccccacggtattgaatgatactttttcaactataaacaaaagcgagatcaacaaaatcccatggaagtttagagacccaatatttacactgtctattaagcaattatctatcaatttacttatttatctgttactttataaatgcattacattatttaaaagtattgatctaactacattttaataacagaatattttctatatgcgttgtttggggaaacatatcaacaggctgacagatatcagcatgataaccaaatccctgcaaatacttaatatcacgagcttgagttgcaacatcacaagaaatataaactatttttttaggatgagcctgaatcaaataatctaaaaattcagccgagcatcctttacgtggtggatcaacaaaaacaacgtctaaatgctggtgattatttacaagttcaatcatatattttccagcatctgcacacttaaattcagtatttttaatattatttagacttgcattagttttagcatctttaatagctgcttcaacgatttctacaccataaacttttttaacatattttgctagtgaaagggtaattgttccaattccacaatacgcatctaaaacaatatcatcttttgataattctgcaaactcaatggctttttgatagagtttttctacttgaataggatttacttgataaaatgattttaatgaaattttatactgattatctaataatcgatcataaatataaccatcaccatataatataacttctttatctcctaaaataacattatcgattcgatggttgatattttgaattactgttttaatcatgggaaactctttagtaatcgctgttacaagtttatcaatgttgtttatttgatcaagataacttattaataccaacattacctcattagtatggtaaccatgcttcgttaatatatgtttgatatttccttgatgtgatagtttatcatacggataaatcttatattcttccattaattctttaactctttttgttatttgattagacaatttattttggatagaacattcgtcacaaggaataatttcatttgatttttgtttataaaaaccagttaccagcttgttgcctttgattcccactggcatttgaactttattacgataataccatggctcttccatcattaagcaatcatttactttaacataacagttaccaattctttctaaacaatctttaactcgtttagtcttaaatagcatttgcccttcttgatttaaatgctgtaattgacaaccgccacatggtttaaaaaccaaacatttaggctcttgacgatatttagaaactttatcaagctctattaatctagcaattgcataattcttcaatactttgattactttaagttttcctgtttcaccaactagcattcctttaacaaaatatgtaaagttatcgactttaacaacaccctgaccatcatgtgtcaaatcaacacattcaccataaaaataatcatttttcttcatcttttcctcctaaaaagacgagcatcgctcgtctattcggtttcatctttctttaaagcacgattagtagcactttcatcaaccatattagcacctgtaaaactgatttcatcactacttggatgcttagttccaaaaattgggaaatctgtatcaccattactagttaaaacaaattctacattatattgccctcgaccattagcagttcctaataattcactataggtactatcttcgcttttgggttgtcctaatgcatcatctaatgtatgtaaggcgttggtggctaattgtttagcatcatctgaagtaatattatcaacaaaattcattgaaatcttaataatccgacaatctacttcaatatcaatgctgttgatatttggatcagctttaatagtattttcaacatccgtaaatttatcttcgtcaatagatatcaacgatgcacaacgatcaccataaacaggaccatcattacctcctgctacgaacacatatacgataaagataattatcattaaaagtaataaaattaaagcaatccatcttttctttatttttctctttttcttgcgtttacccattggctttttttcaatatccttatcaatagaattagttaagggagttttctctatatttttaactgacttatcttcattttttaatgattgtaagtcttcttctaattcatcgtcaaatacaaatcttttttgagacatattcatatcctccttcaactattgtaccaaatatatagatatttgtacattaagaaattcttttctttaataattcaatcaataatttatttgtaagacccggattagcttgaccaccagttttcttcatgatctgtccaactaagaatcccacagctcgatctttaccattactataatcctcaattgattgtggattagcatctaaaacctcattaataattttagttaattcttctggtgaagatatttgtttcatattattttcttcaataataatttcaggatctttaccctcagccattaatatttcaaatacttttttaccctgtttactagaaatagttccatcctgaataaaattaatcatctttgctaaatattctggtgtcaataaagtatcactaataattaaattatttttattcaaataagcctgtacttcacctaataaccagttgcaggcaatcttataataatcagtatattttacgattgcatcaaagaaatctgacatctctttagtttgtactaaaatcaaagcatctgttttaggaatcttatattcattaatataacgatttactctagattctggcatttcgggtatcttagaaataatttcttcaacccattgatgatctaaacgaatcggcaaaatatttggttctggataatatttatagtccacagcatcacctttagcacgcataactactgtttcttttttatcctcatcataacgtcttgtttcttgtaaaacttcaccaccactaattagtactttttcttggcgagccacttcaaattcaattgctttttgaacatttgaaattgaatttaaatttttaatttctgttcttgttccaaatttctcactaccaaaaggacgaatcgaaacattgacatcacaacgcattgatccttcttccatcttggcatcacttacatcagtaaacaataaaatctgtcttaatctttccaaatatgcggcagccgctgctccacttctaatcgttggtttagtaacgatttcaatcaaaggaattccagctcgattatagtcaattaaagaatagtcatcaaaatgaaactgtttagcagtgtcttcttccatatgtaatctttcaatttccacgatctgtttttgaccatcaacttcaatattcattgttccattacgaccaattggatgacgatcctgagtaatttggaaaccttttggtaaatctgaatagtaataatttttacgatcaaaacacactagttcatctatttccatatttaaagcactacatactctaattgcaaactcaactccagctttatttaaaaccggcatagctcccgtcattcccatatcaatgatattaacttttgtatttggagcttcaccaaacgtaactggggctccagaaaacatttttgattttgtctttaactcacagtgcacttctaatccaataactgtttcaaaattcatcttttctacccctctcttgaatattgattagcaaagcccaaagcctgctctaaagcataagctacattaaatactgtttgttcttcaaataaacgtcccattagatttacagcaatcggcattccttcactaaatcctgaaggtaatgataaacttggggttcctgcaaaattacctaatgctagatgattttctaaaataatatattcatctgataaacgatcatctattgcttcatcaactttaggcgcaatacttcctccatttggcgttaaaataatatcatgatcttgataaattttatttagttcattaacgatcaaacgtcttactcgttgggcttttctaaacattctttcttgattttcagtcgctaaagcaagatttcctagaataaaacgacgtttgatatgagctccaaaaccatctgttcgcgaattgatcattacatcatcagtagaattaccagcttgacgatcaccatatttaattccgtctaaacatgaatgattactagtagcttcactattagcaatgatcgtatatgttggtaatattgctttagctaaatgcaaaggaatttctacttcttcaacgatagcccctaattgtttgaatgtttcgatcacttgattaaaattgtttttaatatcttcatttctaatttcatcactaacggtttttaaaacagcaatttttattcctttaatatcactatttaaattttctaaataatgtggtaccggctgggtacttgaagtcatgtcatgtttatcatttccagcaagtgcttcggttacaattgccatgtctcgaacattacgagtaaaagctcctacatgatctaaacttgaagcataaggaataacgccaaagcgtgaaattcttccccaagttggtttaaatcctacgactccacaaaaacctgctggcttacgaattgaatctccggtatcacttccaagagcaaagggaatcagaccactaccaactagtgctgcacttccccctgatgatcctcccgcaatacgagttgaatcccaaggattatatactggtcctgtcaaagctgatttattggttccgcccattgccaattcatccatactagctttaccaatcaaactaattccctgatcatacaatttttctactactgtagcatcataaacaggtacataatcttctaacattttacttgaagctgtcgttttgattcctttagtattataattatctttaaatactgctggtattccttttaacatctcattttcttttacttcaatatttttaatattttcaaatgctttatctttagtaattgttacaaaagcattcaagcgcttttgttgaaaatcaacttcatcaaacaattcttcataatatttatttaaatcaatctcttgattaatgatcaaattatgtaattcttctattgtatatactttcattatcccaccacctttggtacttttatctggttttcttgaacacttttagcattacttaaagcatcctctaagctaataatatcaattggctcatcatcccgtaaaaaagtagtctcaatttcatatggatatgctaaaggttcaattccttcagtatcaatttcctctaataccgccacatgattcataaatatatcatattcatctaccaattctggcatttctccatcgctaatattaaacattgtttttaaacctagcttttttaacatttcttctttactttccataatattctcctaatacaataaactgctcttagccttttcacctttatctttaataataatagcttctaattcatcttgtgaatataccagtactttaatatcaaatcctgtaaactcattatcgatctcatctgcagcagttgacacaagatagatcaattcttcataagtttttacattaatatttaaattaatattcattgattgaatcgtaccatctttatatcgaccataaccaactattccaactgcctcagtagcagcttttttcatattacttttaaagatctcaaactgtgatgatgtttcttcatctgctgctgtcgcttcttcacttgtaaacatataaatatgatagtctaaagtttcgatatttcctacgctgccatcacaatagctttttaaaatataacgtccattaatatcactttcattagtattagttgcataataaacacaaatatttgcgggaatatctttcaaatcatcttttgtttgaagataatcatacaatttactaattgattgtcgtccaaattcttcaaccgttgcatcatccatagaagtagttaaacgtgaattatcttcattacgaggatcaaggacaattgccaaggaaatccctttcaattcatatttatcaccatcttttaaataataatcctgttcgtgaacagtagataccattattggattttcgattccacctaccgattcacctctttgaacttgcaaagtatagggatattcttcaggatcgctagaacgtcttaataatttattcatatcctctgtttctaaatattgaccttctgacatataataatcatcagttgaaaaataggctgttgatattacttgtaattctctaccaattgtttgaaaatcactagtttgaccaaaagaagtatagtaattatcacgatttaaatttatattaaaattaactccccgataaaatgaatcatctaaactatcaacagttgaggcgtcattagcaatctgactttcaacagtctcttttgcatcatgacatcctgtaagtaataaaatagcactcaataaaacagcaattttcttcatcttatggttcctccttatactagagcattataacattattttccttacttaaccatctctaataaagtttcttcattaataacattaattcccaaactttgcgccttagttaatttacttccagcattttcaccagctactaaataatttgtctttttagatactgaacctgaaactttaccaccatgtttttcaattagttcacctgcttgttttcttgataaagtcggcaaagtccctgttactacaaatgtcatatcggcaaatcgatcatcactatctttatcttcgattatttccatatttacaccatagtttttaagttttttgatcatctcacgattttcaggatttttaaaatatttaatgattgcagttgcactaatatcaccaatatcattaacttctatcaattgggcataacttgcattcatgagattatcaatatttttaaactttttcatcaaacttttagctgctgatttacctacattactaattcctaaactagtaagcagtttacttgcatcattagttttactaccttctattgcattcaataaattatcagtgctttttactaatccaataatctttttatccaacaattcttgacgtttatcaatcaaaccataaatatcgcttaaatcctttaaatatccatgattgaccaaagtttctacataagcaaaaccaaatcccttaatatccatcgcatcacgaccaacaaaattaacgatatttctaattagtttacttggacaactatgattagtacatttaatatctgcactatcaccaattcgcatagctggtgccccacatacaggacatttatccccgataatataaggaatgctatttgctggtcttttttctttaacaacacgacgaactttaggaataatttctcctgatttgtatacgacgatagtatcaccaattcgaatatctaaatcatctataaaatcttgattatgtaatgttgctcttgaaactgtcgttccacataaacgaattggttcaaaaatagcagttggtgtaattctaccagttcttccaactgaaagttcgatttctaataactttgtctctttttcttcaggtggatatttataagcaattgcccatcgtggtacttttgctgtattacccaattttcgtcgatcggcaaaactatctattttgactactgcaccatcaatatcataatctaatttatcacgactttcaccaattgctacgattgcctgccatacttcatcagcagttttacatactttataatcttcaattatcttaatgccctgcttctttaaatattcataaccctcactatgactagtaaactctttaccacgaacatcctgaatattaaaaacaaacattgataagtttctttctttagtaattttactatctaattgacgtaatgttcctgcagcgcaatttctaggattagcaaaaagttttttcccgttaatttcctgaatctcgttgactttatcaaaagcctcattcgtcatataaacttcaccacgaacttctaaatactcaataggatcttttaaagtttttttaatatctttgattacttttgcattaactgtaacatcctcaccttgaagaataccatcaccacgagttactgctacatctaattttccattgacatatcttaatgccaaagacagtccatcgatcttatattcaactacaaaagttggatcatccagctgttcttgcatatcatttacaaattgttcaacttcttcttttgtaaaaacatcttgtaaagataacatcggaacattatgtcttacaagaaccccagcttcacgtttagccgttcctccaactttttgtgttggtgaatcacttgttatatattcggggtgctttttttctaatttttttaattcttgcatcatcatatcataatcataatcacttatttctggatcatcttgattataataacgatcattatggtataaaattgtctgcttcaattcattatatctatttaaatcactcattttttcactcctaatccacaatattataccaaaatcaaattaactataaaacaaaaaataaatattttaaccattataattagactaatatttttaatttacttaatcgattatttatttaaataacaattcttacttaataatggataactaaaaataagagatttcaaaaatgacatatatcaatcatttaagaaatctctttttaacgtttacctaaaataagagcaactaacagcatatataaaattctatttattattttctatcctttgtttaaatacttcaaaatcatcttcttcaaatatatatttatatattaattctatttgctcttcattcaaaccctctacccatttactacaatctttttgatatcttcccttaagtaattcaatacaattattcttgtttcttttaatttcctgtttacggccaattccgattccttcttcacgaccaatctcaattccttgttcaataccctgctcgatgccttgtttgattccttcttcaattcttttggctgtcttttcttcgcgttccatctctaaggattcagttctaagcttcgctaacgctaactggttcgctaatgaccatatcggctcattacttctaaacttgtcatacatctttatcaccatctccactatatcttcttctctttccttcattatagcagtgtattcattttttataaacaaataacataatctttctaaatcatttaatcctgcgattcctttttctttgatgatcttatcgatatgtctcatcttgataaaatagcggtaattaaggttttctttttccagctctccctgatcatctcgaaatgcataatctttgatcaaatgatcatcatcttcattgataaagatgatttgatataccggtcttagctgatgatatttttcaccggtatcgatctgttctactaacagtctggccccatagaactgaaagcgcgtgctttcgctattactatttccagccatttgcatttcgatatcaatgattcgacccttttcatcaacggcacagatatcaaggatgatgtttttagcgaggactgtattttgattgatttcgggatttttgacaatcatttgttgacagtcaagatgggtgacagatttaacgataaactttctcagttttatagattctaaagtatctctggaaagcaggtatttaaagaacaggtcattactaaagcgaacattattgttattatcgataatagttttttcatgaatcatattttttcctcctcattatcttttacaatctaaaaaggagaattacttttataaattgaaaaatattcaaataaaaatataaacaggcaaaactgcttaatgttttgtctgtttattttttatcactaatatttaccagcttctatcctttgtttaaatacttcaaaatcatcttcttcaaaaatcaattcaattatttcttctaattgcttccctgttaagctctctatccattcctgacagtcttgatgatactgttttttgatcattttaatacatgtttgtctaagagtttctttttttcctatttcaactccttcttctcgtccaatctcaacaccctgttcgatgccttttttgattccttcttcaatccttttggctgtcttttcttcgcgttccatctctaaggattcggttctaagcttcgctaacgctaactggtttgctaatgaccatatcggctcattacttctaaacttgtcatacatctttatcaccatctccactatatcttcttctctttccttcattatagcagtgtattcattttttataaacaaataacataatctttctagatcatttaatcctgcgattcctttttctttgatgatcttatcgatatgtctcatcttgataaaatagcggtagttgagattttctttttccagctctccctgatcatctcgaaacgcataatctttgatcaaacgatcatcatcttcattgataaagatgatttgatatactggtcttagctgatgatatttttcaccagtatcgatctgttctactaacagtctggccccatagaactgaaaccttgtactttcactattactgttgccagccatctgcatctcgatatcaatgattcgacccttttcatcaacggcacagatatcaaggatgatgtttttagcgaggaccgtattttgattgatttccggatttttaacgatcatctgttgacaatcaagatgggcgacagatttaacgataaactttctcagttttatagattctaaagtatctctggaaagcaggtatttaaagaacagatcattattaaagcgaacattattattattattatcgataatagttttttcatgaatcatattttttcctcctcattatcttttacaagataattagagaaattacttctttttaatttaaaattttaatttttcattataatttcattctcattgttttcattttttctttgaaattaattttttattataaattaatagcttttttgttttcacttaaaacatttaattcaatatattctaaatttctttctaaagtccagtttttaacactttcaattagctgtttccctatcccctgtcctctgaaatctacatcaacaactaaatccatcaaatatgtatagctatgttcaacaagacaactatatggaggtgtttgttgtttttgaactaatgctaaaccaataattttttgatttttagctactaatatatcactatcatcactttcaataatcatttttaaaaacttttcatcttgtttagctgctttaaaatattctggttgtaaattagccatatctaaaaataaaacttgatataactgcttaatttcatcaatatctttaatttttgctttttctattttcatttttattccttgaccctttctattaatctaagaaaagtaaacattttttgttttatattttcaaatactattattaatagctggtaattctttattaccaaactttctttcatcaatatatttttgataccataattcaatctataccacctcacatccttttaaattaccataataatttgtgatattccatttaaaaaagttatatcccttcatctattttgacacttgtaatattatttttatacattgaatatccttgaatcgtctctttataaataagattagttacataagtattaccaatccaaacatttctttaacgattagaatcaattacatatctattaatattattaatgattacagttaaccttaattatataattctagtaaatatcagtctgtattagctaatacacccctctctaacaactgatcattcatctttttaataattttagttccattataagtattgatattacaaatggcaaatcatgacaatttaaattaaaacaaacaaataattcatcattattagttaataactcttgcatttgttcctcctaacatctttaaatattttacatctataatataactttactatacatattttcaacaaacaataaaaagcactcctaagagtgctaatttgtcagcttctttaaagccttatgtcctgccatcaaggtttttaaccctgccggtaattcaaacgcaatatcaagagtctttccgttaactttaaccacaacccctttaccaaaagtatcatgcatgacaaaatcaccaacagtccagtctttaacctgattattaccgactaaatcagctttattaagtgatgtatttatataattagctgttttaaaacgaggttttgctccaatatgtttgattccctctttaccaacttcatcaataaaacgacttgctattttaggtgaatcagtgacaaaactaaacccttcgctatcagttaaaaacaactgcttcttcgctctggtaaaagcaacataggctaatctgcgctcttcttccaagccttcatcagattcactgatcgatctaaaacttgggaaaattccttccgatagacctaaaacaaaaacataatcaaattccagacctttagccatatgaattgtcattaaacttacgtattgtttttcatcaatattgtcattatcagtatataacgaaatttcttgtaaataattttcaattgttgctaaatcaggattttgattctcaaattcataaattgaacgctgtaactcatgaatattatcaattctattttcttcaagatcctttttcagcatttcaatataaccagtattattcatcaactcttcaaacatttgatgcatcggtaaacttgaatgttttgctgtttcgattgcctcaactaagatctttacttcttttttagcttttgtagacaatctgatttgatcactaaataaagttaatgcttcatacaaactaacttgattattcaaagcaacctgctgaatattttctaatgtctttttaccaattcccctactaggaacattgataattcgttcaaaagctaaatcttcagcattacaaactaactgtaaataacttaaagcatcttttacttctttacgattaaagaatttaagtcccccaaaaatccgataatcgattccatgagaaattaagctttgttcaattactcgtgataaataattagcacgatataatatagcaaaattccgataattgacaccttcaacatcattaatgattttttctatttgcccacaaatataatcagcttcttcctgttcacttttaccagtaaagtgaatgacttcagcaccaccggtagcctcagtatataagtctttttctaaacgattttgattcttacgaatcaaacagttagaaatatttaaaatattacctgttgaacgatagttttgatctaaaataattgttttacatggtttaaagtctttatcaaaatctaaaatataattaacatcagcacccctaaatgaataaattgtttggtcagggtcaccaactacacaagtaatcgctttttttgccattaactttactaaacgatattcaatattacctacatcttgaaactcatcaacatgaatatattgaaaacggtactgccatttttctagcacatcaggataattttcaaaaatataaactgcttttaataataaatcatcaaaatcaagcataaagtgattttcctgatattctaaatattctttataaaccatggctttttttatttcaccttgaaattgtccagctaattctaaagcatgttgaggcgttatattagccattttataacttgaaatagaagcgatcatgcttttgatactaatcgtctttgcatcaatatctaaattgttataaatttttttaatcaatgctttttgatcttcttcatccatgatcataaaagtactaggataattaataacgttgatatgctgtcttaaaattcttacacataatgaatgaattgtacaaattaaagatcccataccatacggtcctaatatattagtaactctttctttcatttcatttgcagctttattcgtaaaagtaatcgcaaggatcttatgaggatcaacaccaacttcatcaattaaataggcaattcgatatgtaacaactctcgtctttccagaaccagcaccagcaattattcttaaatgactatcaagataagtagctgcttctttttgatttttatttaataatttatctaaatccatctcatcaccaccaccgctttattatagcttatatcttttataaaagatacttatttctaagtatttttctactttttaaaactagataatataacctaaaaactcaaatgatctagttataattccatccagcttactaaatataatatttctattttattaataattttgccctaaaaactaatattcaatatatattactaatactatcaataaataaaaaacaatgtataaataatacactgtttttaatatttatgtgagcgtccaactaaatcgtttatatcatcaattcccaattgagtaagtaaagaatctaaatcttcaactattttcttacaggcatatggatcaattaaattttgacatccaattgccacagcactggcacctgctgacatcatctcaataacatcacgggcactttgaattccccccatgccaattacaggaatatcaacagcctgacttacttgataaaccattctaagtgcgacaggaaaaattgccggacctgaatatcctcctgttttatttgcaatgatcggcttccctgtttttaagtcaaaacgcattcctacaagcgtattgatcattgtaataccatcagctccagcttcctctacagcttttgccatttcaacaatatcggttacatttggtgataattttacatatacaggtactttagaaacagctttaacacggcgcgttagatctgctgccatttgcggattagttccaaattgaattccaccactatgaacatttggacaagaaatatttaattctaaagctcccaccatatcatgagttgataaacgcttagctgtttcgacatagtcttctggcgcactaccaccgatattagcaataactttatcagtatataatggtcttagtttttctagttcctcattcattactgcttcaactccaggattttgaagtccaatggcattaagcatcccgcttggtccttcagcaattcggggtaaaggatttccataacgtggttctaatgttgtgccctttaacatcattgagcctaaaatatttaaatcataaaattttgcaaattcatatccaaatccaaatgttccactagcaggaataatgggatttttcatttccagcccaggtaatgatactttcaaattagccatttacgatcacctcattactttctaatatcggtccttcaacacaaattcgtttatatggtttagttttaactttgcatgaacatcccatacaagctccaaaaccacatcccatacgagcttcaaatgatagctgcccgttttcaggataatttagcactaaagcatctagcattggttctggtccacaagtatagtaattatcaaaaattaaaccttcatttttaattacatctataaccgttcctttagttcctacactaccatccatagttgcaacatagactttagaaaattcagcaaacttttcttgataaaaaacatctttagcactattaaaacctagaactgttgtaacttcaattccctgagcttttaattttttacctaaattatataaaggtggtgttcctaatccgccaccaatgagtaatgctttaccatctttgatcgtaaagccatttcctaaaccaatcaaacaatctaaataactaccgatttctttattctttaaaagttcactaccttcaccaacaactttaaaaacgataacgatatgattttcatcataatcactaattgacatcggtcttcttaaataaggctgtaaactatcattgatcttgatattaataaactgcccgctagcactaatatatttagcccctgcaccttctaaaaccatttcatatacttcatcagcaatattttcaatactaacgattttcatcatcccttgtaaattagccataatacctcctatattttagtaattacaccatctaaaacatgatattttaatacaccataacattttgtatccaaaaatggggtattaattgatttagatttaatattatctttagttattgtatattcttcttcaagatcgaaaacagctaaatttgctttatagccaatttctaaatcatgatcgatctcaattactttggcgggatttaatgacatacaagtcaatactttttctagaggaataagtcctttttttacaatatatgtatacattaaactaaaggcatgctgatttccgattattccaaatggggctttatcgattggcttattcttttcagcaattgcatgtggtgcatgatcagttgagatcactgttacagtaccatcattgatgccagcaatcaaagcctctaggtcctctttacttcttaatggcggattcattttataattaggattcatatctttaatattatcatccgttaaaatcagatgatgtggacatgcttcaccactaacaagactatttgtcttacgtgcttcttttaaagccgccacagtttctttagtagaaatatgacaaatatgatagcgatttcctatttcatcagcaagttttaaatcacgaaccgcatgattatattcagaagcattattaattcctactaaatcatgatccttagcataattcccctcattgatacatgctcctggctttaattcaccttcatcctcacaatgagctacaataattgaatcatttgccttagcagctttcattgctgcttccatcatatctttagactgaactcctttaccatcatccgaaaaaccgataacgatcgtttctttactattcgcatcaaaatccactagttcttgtccttttagctctttagtaattgcgctatatgtataagtatgtacttttgcatctttttcaacccgtcttttaaaatctctgatcgtctcgacatcatccatgcagggaatcgtattagccattgctactaaatgcgtatatccaccatattttgctgaattagtccctgttgcaattgtttctttatgctcaaaaccaggttctcttaaatgtacatggatatcgacaaatcctggagtcaacaatttaccagtaatatcaattatttcatcagcttgatcaatattttgtttaatatcaatgattttatcattttcaattagaacatctaacttctggattttaccatgataaaaaacatcaccatttttaaataatactttagtcatcacctaacacccgattcaataatgccattctcacaaaaactccattagccatctgtttaaaaattcgactttgtttacattcaacgatttcatcagcaatttcaacattacgattaaatggagctggatgcattatgattgccctttctttcattttattaactctttcacgatttaatccgtataattcatgatattgatcagtagttaatttcattaaactatgatgccgttcatgttgaactctaagcagcataacaatatcaacctctggtaaaatcgtatcaaagtcaacataattataccctggttcttcaaattcacgcggaccgctagtataaacttccattcctaaacgtttcataatttcataattactatgagctactcttgaatgaacgatatctccaacaattactatttttaaaccctcaaaatgtccaaattcttcacgaatcgtcattaaatccaataaagattggctaggatgatttcctgttccatcaccaccactcacgataggaatcgtaattcgatcaaccagatcttcataataattttctttcgggtgtctgataacgaccgcatcacaaccgatcgactcaaaaaattttacagtatcatatagagtttctcctttttgaacacttgaattagctgtttcaaaattttgagttcgacagcctaaattataagccgctttatcaaagctataatgcgttcttgttgatggttcaaaaaataaatttgcgacaacttttttgccattataatctacctttttcccttttttaaattcttctgcctcatctaaaatcaaattaatatcagttgttgaaaaatcttttaatgtaaatatattcattgttttcctccataaaaaatacctctaacgaggtataattgggaaataatattcattatacccagttgatgtatcttttttctttattcatcatatcaaatatcattgattttgacaattattttaaacaaaaccaatttgatttcagccatttaatttctgaaatttcttttgtaaagcttcttctacacaagctggtactaagccagcaacatgccgcttatgactaaccatttcttttactgctgaagaagaaataaatgagtgtgatggttttgtcattaaaaataccatgtcgacatctttatccaaatattgattagaaaaagctaactgtagttcatattcaaaatccatcgttgctctaattccgcgtactaaaatttttgatccgacatctttagcatactctactgaaagcttatccgatgaatcaacgatcacattatcaaattgttgacaaactttttttaataattcttttctttctgcaattgtaaaaagcccctgtttattgggattaatacaaatcgtcacatacaaaacatcaaacattctgctggcacgttcaataatatctaaatgtccattagttacaggatcaaatgttcctgcatatactgcaatatttttcttcatactcttacccctgatatttaaatacattcaatgctgtaataccatagtcattttttttaagcaaatttatttgctcaaaagctttaaaaacaacttctttcaattcttctaccataataatacagccctcattcaacatttcattctcaattaaaaattctaatattccatcaactaatcctttgccataaggcggatctaataaaaccaaatcaaacttaattctttcttcactaaatttttttaatgcttttcgataatcaagtttatacactttagcattttcaatctttaaagatctaatattttctctaattatttgaaaagcagcgtattgatgatcaacactataaagaaaatcacagcccctcgataaagcttctattcctaatccaccactacctgcaaataaatctaatacatttcccccttgaaaataaggtccgataatattaaacatattttctttattacgatctgtcgtaggacgtgttagatttgattttacagtttttaactgtctacttttatatttacctgctattactctcataaaccctcttataacttatatggagataaatccagttcttttgatatatttccaaatacgattttagttatttcttccaaaaaatcatttaagcgatgatatttttgataataatcaataatatcctcattacaactaatccgacgttttaaatctttgatttcttctttaatttgcgtattatcaatatattgttcatattttcttatttcttcatattgatcaagtttattttgataatcccgcaataactcttcgatatcttttgtatgaagctttttttcagcttcaagataatcaagataacgttgatccctttttatttcatttattaatttatctaatatttcttgcatattcacctacatcatcatttccaacatatttatcagcattgaaacttgatctattttatcaataaattgttgatttttttcatctttatattcttgtactagacgaccatattcttgaggatatctagataaaacaatataccagtggggatgataacgaagataatatcttatttcttcattcatcataccattttctttctctttccggttcttttttatctaaaaaagaactagctacattcaaaactttttcaattgaactcaaactatttgataatgcattcaaatcaatatttttaataatttcaattatcgcatttaaatcaacattactattagttttatatggctgccaaaatttatcatctttaccatacatcacataaatctcatataattgctgccaagtataacgaccatttaaaacatcctgctttacactagggacagttttcaaaaactctttaaattcgtccataatatcacctagtatattatatgttttgatctttaatcggtgtcaaatttttgccgattatgcttagcaattattgcctgagcgattccaatagccacaaaggcactgacagttgacgaaccaccagcagaaataagcagcaatggtacccctgtcattggaattaatcccgaaactcctccgagattaattattaaatgtaaaaagaaatatgatgacactccgagcaaaataattcttgacttattttcttttacttcgtttgaatattttaataatttaaaaatgacaacacatgtcggaataattactaaccctaagccaattattcccagctcttcataaattatagctccaataaaatcattgtgagattcaggaatatagccatatttttgggtagaatttccaaaccctaagccaaatagtcccccatcactaaaagcaatcagcgcattcaccaactggtaactgctattataaggatctgacattggatcaagccacgaatagattcggcctaactgataaggctgtaagacagtggttccaataattgtcaatattactgcacaaacaccaataaagatccacaccatttttttatacttcttaaaatactgtcttggggttccaataaaacaaacgaaacaaatacctaccagaatcacagttgttccaaaatccttttgaataaacactccgacaacagctgcaataaaaactaagagcattggtaaaaatacgcattttaaaaacttttctttataaaatgcagctttcaatgctgctgttttaaatcgtcccttaacaacaaaagctttatcactttcggttaaaaaataactcataatcaaaatcattgcaattttcataaattcagctggctgaatactaaacgccccaccaaacttgatccaggcatgagaaccatgagaatcagaccaaaatctacatatcgtcatcaaaataattcctaataaatataacttcattgacgttgtataatcaatatagcgtgttttaaaaactctagcgataaaaatcattacagccgctccagcaataacataaactgtttgcgtactcatattttttatcgctaaagtaaccgttttctctgatgaagttacacttccaattgaagctgaaccaatcataataattccaaaaacagcaagaataaagacacttatatagattcctttatctacaccccgacttgtaaaaagctgttttaatcgatcaattattctttttatctttgtaaaccttttttttaccaaattactcacctacttgaatccagtcattttctttagctgcttttactacctgataaattgaatagtgggaaatctcataaaattgtttatctaactgtttttccgcacttttactatcaacaataactttaaacttgcgataagcattcataaattcttctttactaatacctttttcatatgccttttctactgcattatataaagcaattacatcaattatttcttcagttgaccaattatagtctaacggataattataatccatatttaatcactccttaatttttttctattataacgtaaaatttaattattatctacaataacccaggcaaaagataaatattagaataggatatactaaaggaggtgataatatgaactgtggatttaactattctggatgtggatgcaattcatacagtcctttcatcacaaatccatttggatgctgtggatgcaatggtggtttttcaatgtctaactgtggttgtggatgcagcaacagctgtggatgtaacaacggttttggatcaacaaactggtttgcaatcgttttagtagtattcttattattgatcatttgtggaaattcaagaattagagtcggataaagtctttatttcacctcattttatgatataatactatcagaatttaaatgaggtgaaactatgttaacaatgaaagatataatcgatgaccataacaaaaaaattcgtgaagtttcaaaagaagtatcattgcctctaaatgaggaagatcgtaatctcttattaaaaatgcatgaatttcttgtcaactctcaagacccagaaatttctgaaaaatatgatttacgtcctgctgttgggattgctgcgattcaactagggattcctaaaagaatgtgtgctattcatgttttagattatgataaagacggaaatattactaagagtaatgactatgctttagttaatcctaaaatcatttcttatactgaaaagaaatcttatttaaaagatggtgaaggatgtttatcagtaaatgaagaagttcaaggttatgtaccacgctacgctaaagtgacagttaagggatatgatatattgactgatcaagaagtgaaaattgttgctcgaggttttttatcaatttgtttacagcatgaattagatcattttgaaggaacacttttctatgatcgaatcaataaagataatccttttgcaccgatagaaaatgctatgattattgaataaaagtttaaagactgcaagttttgcagtctttttaatatcatttaattctcttgctctttacaaactttgatcccagtaatattattactgctattgcagcacaaccaccatatagtcttaaatgaagtaattcatctagcatataacaatgacaaacaaaatatttagcaaatactatcactgcaaatatcaatgcaagtaaaccaatatttataagactatattttaaatccttatctttccaataattaataattaaaatcaataagtaagctattaccaatattaatattacataatataatttattgatcacgttagaaatgctatctactctaagcttttcactttcagtatatccatttggaaatacttcttcataaacaagtgcgcttaaataattatttaaagtaacgaactcataaaagctccaaaaagccaaaatcaagtatctaattactacaattataatattctttaacctaaacataattattccccatgaatcgtttgtgtataataaggtgatctatacgtagaagccattccataactgccagcttcgattctttcatagccatatttataagtaaaatcaacacttttattaacagctgcctctccagcagaatcttttgatgataattttgattcactaaaagatgtaattactgcaatatttttatttatccttattatatactatcatttttttatttctaattattatttgctgtatatttttaataagcagctaatacatactaatatctgataaactattattttgaaaacttatatttttaaatataatttattaatcataaaacttacttttcctcctctccctgtcaaattaattaataaaatatattttaaagcttttcttatttttactataacacaaaaaaaaagaaaattttcaatttcacaatttaacggttaaaaataccattaaacgataaagatcaattcatttgatacaacaatttatgtttttaaattcaaattattatcaaatagccttttaaaatagactatttaattttataatctttttttgattcaactgctatacgatcttaactaagattcatctaacatacaaaatacttgatgacatgataaaattaaatcctgctttaaaataatagataaaggcagctatttacagcatttattatagaaatattattatagttgtgatacaattttgtcaatttgaggaggatatatcaatggataataaaaattatggttttgaaacattacaaatacatgctggtcaaaaacctgaccctgtaaccaaagcaaccggtatgccgttatatttatcaaatgcttttacctttgaagatgccgaccaagctgcaagaattttcgcattagaagaaggtggttatttttattcacgtttatctaaccctactgttgatgctttacaaacaagaatggcagctcttgatggcgggtttggagctgttgcctttgcttcaggaacagcagctattatgggattgataatgacagtttgtcaaagcggcgatgaaatcgtagtagctaataatctttatggtggaacgattggttctttatcaggaacaatggaaacaatgggatttaaatctcattttgttgatcctaaagatttaaaagctttagatgctgcaataactgataaaacaaaattaatctttgtagaatctgtaggaaatcctaatggtgatatgttggattttgatgctataaataaaatcgctaaaaaatacggtattttatttgttgttgataatacgaccccaacaccatatttatttaaaccaattgaacatggggctgatttagtagtttattcaacgactaaatatttagctggacatggtaatgtcatgggtggaatcattgtcgatagtggtaactttaattggaaagacaatcctcgttatcctttatttaatatccctgataaagcctatcatgatattatttatgcgaatttaggtcaagctgcattttgtacaaaagctgttgccaaaacattacgtgatttaggtggttgtatggcaccatttaatgcctatatgactctacttggattagaaacactatctctaagaatgaaaaaacatgttgaaaatgctcggatattagctaagtttttaaatgaatgtgaagatgttgaatgggtaagttatgccgaactaccagataattctaattatgaattagcaaaaaaatacttccctaatggttttggtggtctttatacatttggtgtaaaaggcggtgttgctggtggtaaaacagtcatcgataacatcaaattatttattcatgttactaattttgctgattctcgttctttattaacacatccagccagcactactcatgctcaaatgtcagaagaagaacgtttagcaggaggagtaaaacaagaaacaattaggatgtctgttggtttagaagatgtcgaagatttgattgccgatttaaaacaagcttttaaaaaaatttaaaattattagcatctcaaattgagatgctatttttattactatcttatttaattatcatgaattgccttttctatcttacaactatgttttttagtctttttatcataactgattcctactaatagtaaattatccctatatttttccaatccctttggatatttcttttctttgatttgatctatcgctgtttctgcttcataatcccattttaactctactatcatcgctggtttatcatctttaggaataaacaccatatccgcatatcctttcccacttggcatctctcttattatcgtataatgatttcttgcatatatatacgctatcgaaattgtataggataacgcattttcattattatatgttaatatcgctgtatccagatgcgcttcttcgatatacttagctactaattcttcatctctattccatgttgcttctaataaggctctgctgtttaataacgccttcgttgtttcattccatgatgaatcttcaatcgatgctataaatgaactggttacttccttatttggtatataacatgtctgattggaactgttatatcctagataacctagatggatcagcagtgtcaagacatcatcttttgatttgaacgtcgtcatatcattttgaaacttgtctgtattcaaatatacttcttctccagccaataacttaacaacatcatcttttaagccgtcataattcatatcgatatacactcttaaggcttcatacgtctcggttgcactccagtagttttcgtattttctgtccattaaagcataaacaacagaacggtggttataaactgataaatcatctgtcattttatatccatcataccagtctttcattttttcatagtccatatcatattttaaacataaatcttgtacttctttttctgtaaatcccatgaactcttccagtggtgttgggttgagtatcgatacttccttaaacatattcaaagcactatgggttccatatttcttgattggcaggatccccgtcatataacataatgatacatagggtttgtctttcaacagattccttaaaaaatccaaatactgactctgagcttctttattatttttgtattctctgaagatacagtcccattcatcgataacaaatataaatcgttcatttacctcagcataaacatcttctaaaacctgtataagatcatcaatatcaaaatattctatatcttgataaactttttttatatctctaaaaattaatttcgttagaagaataagcatcttatcaatatcgtgtgttttacttaaaaaatcctgcatattgatatgtatcacattatgctgatttaagtgcttttgatataactctgtttgactgatttttaaacgattgaatatttgtgatgaatcacagcctttagaataataagctactaacatattggcatcggtactctttccaaaacgtcttggtcgtgatatacaaagatatttattcactttttctttcaaatgctcaattctttcaatcaataaagatttgtcaacatatatttctttattaaccgcttcataaaaattctgatttgttggatttaaatatattcccatagaatcttcctttctgttatgaagtgacctttgtcaagtgaaaattacacattcataataaaattatttaattttatcatcaatggcatacaaaagccccaaaatactagatttatcgacagttaaccactctgttatacggagattggctactccaaggttaatggttcgtcaaataagttctaactatctatatacgtgaatcatctataatttatgatattccagatcgcgacttcttttatatcttatttatgccacaaagaaaggaccgtagataactaaacctgcttctccttttttgaggcttttctatgccattgattttgtgttctttttttctcgatttttgtcctccatttcttattttttctttaaattttcataattgtatagaaaacatctttttacatcttctatattcttcctgtttccattccccatataaatcctgctagttcccttgccactgccatgatagctacattatatggtttccctcttaataccatccttctaaatcttttttgtaatctttctactgccttatctgcatatgctacgatttcatcctcctgtcctttttgtctttttttcaacgcttttgatttctttccaactgttcctcttactaatgcctgtgtacattctaccagtgtctttctaaccatcgcattccccatcttggtgattggtgtattgctgtatttctccgcgctcgaattctctcctggaagcattcccagattcgccataaatgcctttgctgttggaaatcgctgaaaatcactcactgtgacatgtatcttcattgctgataatgtatctattcctttgaaacaggaaattttagaaaccggttccttatattcctcttcttttgaaaactcttctatcctttcatcatatttttcaatacgttcatttaaataatcatagacttttaaatattcatttaatgtttctcttacgattactggcaattctatcgtttcaagccatttgatatgggccactgtccagttgcttttcccctcatatcttaatcctcgtctcaataccaatgcactgatctgctgtttgattctctttcttgactggatgacatcttctcttagacctatatattccttgatttcattgtcatgttctgttggtacatgaacagctttgtatgaatcgtgcataagattagtggcaatattaaaggcatccatcttatcattttttacttttttatttttgactgatccatgcattgttgatggtgctaatataacacatggaatatcatggtatgcaagttcatgatataaggaaaatcctaaacatccagcttcatatcctgttaaaatatccacctcattttcttcactcattctttctttagctgacttaataaatttaagaatattctttacttcagcagcacattttgtctgtgcaataacttctcctgttgatgaattgattccacataaactgtacgtatttttatggacatccatcccaatataaattatacttttcatagtgacctcctattgtcgttatggtatcgactttcataattttatttttttactaatcttattatgaatcgtaatccactttttgacaacttaggaggtcacttcatattatctttatattgtaattgtactaaaacactgcgtgttagtccatttctaactttatttttttaatatttttacttacatcttcaaaataacggctttcctctttaatactttaattgtcattttaatacaaaaaaatgattaaatatggatattaaatctataaatgataaaatcattcaatatcccatacttgtgaaatgaaaatgatagtatcttgaaaaactttttctaatattactgttaccaattatatagattttattggttgttttcttgatgtcactcatttcgacaataaatttgatttactcaaaatctttttaaaaattatcatatttcacttcatatatccctctattttcgtctatctttattaatttgattaaaattgaaatttaatatcatcataagtaattcctacaatagttttgttttcacacttataatttttactcatcagtgctaatattctttccataataaaagactggtatcccagtcttttaattattatttttttaagaaatctggatatgcttctgaaccatgttctccgatatcaagtccttctagttcttcttttggagtaacccgtaatccaattgtctttttaataattgtaaacatcaagaaagaagtaatacaaacccaaagagcaactactacaactccagttaactgtgtaatcaataaatcgaaaccaccaccatagaataatcctaaaacgccttcacttgcaggtgtattgcaggcaaataaaccaacagcaatagtaccccaaacaccatttaagcagtgtacacctactgcaccaactggatcatcaatatggaatttttgatctaagatctcacatccatatacaactagcacaccacctattgctccaattataagtgcaccatatgcagaaacgatatgacaaccagctgtaattcctactaatccagctaaaataccatttaaagtcattgaaatatcaggtttaccatattttttccaagttaaaaacattgctaccaatgcgcctgcacaagctgataaattagtagttaaagcaatatgtcctacatatcctgctgcttccaatgatgatcctggattaaatccaaaccagcagaaccataaaataaatacccctaaagtagccatcatgatactatgaccaggaatagcttttgctttaccatctttactatatttaccaattcttggtccaagaacaattgctcccatcaaagcagcccagccacctactgaatgaactgcggtagatcctgcataatcaataaatcctaatttagataaaaatccaccaccccagatccaatgaccagaaattggataaatgactaaactaattacgaatgtataaactagataagatacaaattttgttctttctgccatagctcccgaaacgatcgttgctgcagttgcacagaaaaccgtttgaaagaaaataaatactgatggtgataaagcttcaaattgtggcaaattaagtttagtcggatcaaaaaatccactgcttccaataaatcccccaattgaatcaccaaacattaatccaaatccaattataaaaaagataattgaaccaattgcaaaatccataatatttttcatcaatacattattacaattcttttgtctagtaagacctgcctctaaaattgcaaatccagcctgcatcagcatgaccattacagcagccaaaaatacccaaacgatattaattaattgttccataaaactaccccctaaattttataatgctttttcaccagtttcaccagtacgaattctaaccgcctcttctacaggatatacaaacactttaccatccccaacattacctgaagaaagtttttcagtaaccttatcgattaccttttttacaacatcatcttttactactgtttctactcttaatttggaaactaagtttacagcatatttggttccccgatattgctgagtataacccatctggttaccaaaccccataatattggaaaccatcataccagtgatactacattcagttaaaatatcttttaaatcttctaatttttctggtctaataatgatttctaattttttcatctttttattatccccctttatttttttagattttaagcttcggtgctttaaatcttgataaaataatatcaagataataatttattgtcaataataaattttattttttatttatacattaaaaaaagtggcttactaaccactttaaaaatatctaataaaattcattactaagataaactactaataataatcccttaccaaatttaccatatcttcaatatataagcgagctccatcaattacattttggtcaatttcttttagttgtttaaaagttaatttaaatgaatattgctctctcattaatggtaaatcggtttcttgacataatttaatcatatttttcattttatgatcatttatataaaaagcattgaacaaagcgacattacgaactttttggcgatttaaattttttataaaagattcaagctgacaatctttccaggatgaatcatcaaagccaattatcattaaatcaacacaaccacaataatcaaaatcatctattgttttagcgtatgtcttgacccatcttgccattgcttcagctacaggcttaatatgtcttgacttatttgtgtacaaaacttctattctcattagtatcacctattataattctaaatcgtttttgtgaactgtatataaactggataaaatatattttttaatattagaaatttaagattgtggcacactaaatacggaggtgaattgatgaaatttataaaatctattagtttaattacatgtttacttattttactaactggctgcgttaaaggtgatgtaaatatcgcttttaaagacagcactaatgctaatattgaaattaaactgttttttcccgaaagtcttttaaatgagtataatacatcaattgatgagttaacggataaattgaaagaaaatggtttacaagactggactagtgaaaaatctagggaatcaatcaatggtgtaacgtatttagttttagatttaaaggctcctgaaagtattaataaaggtttaatctcttttcttgaatatcatgaaaaagaaaaaagttatcaagttaagatggatttaaatttaattaatgatatttataatactagtgaattaaaagatataaataattattctctatctaatttaaaaacgatgggtttagaatttaatttaaatattgaaatgcctggtacaatcaaagaaactaatgttggtaagatcgtcaataatcaagtgcaaatagatcttattgatttattgactcaagataaaataactacgatttctattaattccataagtacccataaaaacagtttccctattaatcttttaattattgctggtttatcgatcattctctatttgatcataagaaaaagtaaataactacttttttttactatctaaaaatgttagaattaggcagtaaaaaggagaataagatgaaaaaaagaaattgtattattggacaatctggaggacccacaatcgccatcaatgcaagtcttgcaggaatcattcataaagctaaatatagtaatgaatatcaaaacgtttatggcatgatcaatggtataaagggtctgttggaaggtcgctatatggatcttctgaaagaatttgatactggtgaaaaaattaatgcgctaaaacaaacaccagctatgtatttaggctcttgtcgttttaaattaccaactcatatagaaaatgttgatacctatgttaaattatttgaaatcttaactaaattagaaatcactgatttttattatatcggtggtaatgattcaatggatacggtaatgaaattagacgattatgctaaaagcattaatagcccgattaaattcattggtattcctaaaaccattgataatgatttaatggggactgatcatacgccaggatttggctcagctgcaaaatatgtagcttcatcgattttagaagtagtacatgatagtttaatttatcaattgcaatcagtaacaattattgaaattatgggtagaaatgccggctggttaactgctgcagctgctctagctcgcaatgaatacaacgaagcccctgatttaatctatttacctgaggttgtttttgatacagaacgttttttaaatgatattcgtgagatattcaagagaaaacgctgtgtcgttattgctgtcagtgaaggaatcaaggataaaaatggtaatttcttagatgataattccaaatatgttcaaagagatgcttttggtcatgttttacattctggtactggaaaaatgctggaatcattagtatttaaggaatttcaatgtaaagttagaagtatcgaattgaatgttttacaacgttgtgcaatgcatattggtagtaaaactgatttaaatgaatcttttgtaattggtcaaaaagccgttgaaacagctattgctggtaaatctggtcaagtaatgggatttaagcgcgtttctaataatccttatacaattgaatatatttctactgatgtgcgcgaagttgcaaatttagaacaaaaaatacctacagaatggatcaatgaagctggtaatgatatttctcaaaaattatatgactatttgttcccattaattcaaggagaagtacatatcaactatcaaaatggtattcctgcttattatagttgtaaacatcttaataaataaggattagatgatttgtctaatccttttattattgccatatatcttttagaatatttgtggcttgatcaatatcttgatcaagaattcctgaaaatgataaagttatttgattatttctatttttatatactagaatatcatgttttttagctatctcaataaacttatcaattaaatcgatttcaacagacatcgtgatttttaatgctgtttcatataaatcaaaagtataattaggaaaagcttgttgtaaattttttaaaagatgctcacttttatcacgataatgttttcttaaccttcttaaatgtctagataactgtccgtcttcaatatacatcgctaaagctaattgttctaattttgaggcagtctgatgatatccatctgatttttgtttgaataatgacaataattgatcaggtaaagccatataactaattctaattgatggtaataataatttagaaaaagaaccgatataaataatatgatcattatctaattttgccatcgcatcaattggtttagtattgaattttagttcaccattatgatcatcttcaattatataaacatcattttcttgagcatattcgattatttccaaacgccgctgctgtttgattggatgtccatgataacccccagatgaactatttaaataaagtaattttaaatttgctttttttaatccttcaattgtaattcccttatcatcaactggtaattttacaacctgcatatgacaatcatgaaacactgcttcagcctgcttaaacccgccttcttcaattccaacaatattatccctttcaaacaaactacagacataataaagtaagatttgaaatccggccccaactacataattattgacaggtcttcttacccctcggtattcatgactatatttttgtaatgctttttttaagaccaattctccttgtggttccccataactcatcaggtcatcactttgattgagagctttcttaatatattttttccaaatatctaaattaaaactctcactatcaactaatcttccactaaaatcataacgatatttatgattatcaaattgttcattaatttgattgagattttcatttattgcatgcttattgtattgtacatctacaaaatagcctactttctcttttgtataaacatatccctctactaataactgcaaatatgcactttcaacagtagtcttactaacatctaattgtttagccatttttctgattgatggtattttgtcgttatactttaaataccctttttcaatatcatcaacaattgtttcatatacttctaaatacttatattctttcataaacagtcccctttaaaatcattataaattattattttaataatgacaattaaatatatttaatttttttataccataatcatcaattttatgatataacaaaaaaaagggagtgaagatatgagcgtaaaaaaaagtgttttagaggtaatcggtagaacacctcttattcaaatcaatcgtttcaaagaagcaaaaaatataactaataatttatatgcaaaagtagaattttttaatcctgggggaagtgttaaagatcgagttggattaaaattaatcaaacaggcctatcaggaaaaactaatcaatgaaaaaactactattattgaaccaactagcggtaacacaggaatcggattagctattgcctgtgccatctataaaaatgaattgatcttgaccatgccagaaacaatgtccatagaaagacaaaagttattaaaagcctatggtgctaaaattgttttaacagctggtgaaaaaggtatgcagggtgcagttgataaagcaaatgaattagcacgtaaaattgaaaacagctttattccaggacaatttaccaatcctaataatccattagctcatgaagaaactactgctcttgaaataattgatgattttgatgatacgatcgattattttgtcgctggaattggtacaggtggtactataaccggcatcgctagagagctaaaaaagaaatatcctgaaataaaaataattggtgttgaacctagcgactctcctttaattacaaaaggaaaagcgggcagtcatggtattcagggtatcggagcaaattttattcctgaaattcttgatttagatcttatcgacgaagtaataactgtttcaactgatgaagcttatagtgcagctagattattagcaaaaaaagaaggtctattagttggtatctctgctggagctgccttacatggtgcctctacattatcaggtgaaaataaaaatgttgtcgttttgcttcccgatactggggaacgttatttatcaacagctttatttgaataatttaaaagctatcgttaatgatagctttttaatatatttaatctgatgatactaatgctgttgaaagatatctttcacctgtatccggtaaaagaacaacaatgttttttcccttattttcttcacgttttgctaaaacagttgcgccatacattgctgctccagatgaaattcctactaacgctccttcagttttagcaatttctcgacttgttgcaaaagcatcttcattagatactgcaataacttcatcataaatacttgtatctaatgtattaggtacaaaaccggcacctattccttggattgtgtgtggccccgctacaccttttgaaagaacaggtgaggctgctggttcaattgcaacaactttaatatccggatttttttcttttaaatattttccaactccactaattgttccgccagtacctacgccagctacaaaaatatcaatatttccttctaactgttgatatatttctggtccagttgttaaataatgaatatttgggtttgcgggattatcaaattgacttggaataaaagcatttggtatttcttttgctaattcattagccttattaatagcccctttcattcctaaacttcccggtgtaagcactatcttagcaccatatgctttcaacagattccgacgttcaatcgacattgtttctggcattgtaagaataacctgatatcctaaagaagctccaatagcggccaaaccaattcctgtattaccactagttggttcgatgataacagaatccggtttcaagattccatcttcaatagctttactcaacattgcattagcaattctatctttgacactgcctgcgggattaaaatattctaattttgcaaaaatattagcatttaagctgtgtttagataaataattatttaattttaaaattggtgtatttccgattaattcactaatatgattattgtaagtcattttttacctccgttatattatattattaacaattaataatatgtttataattcctatatttcctacttgtttaatatgattatatcatttatttattttttgtcaattaaaaaagggacaaaataaattttgtccacctgggtgatagtgcattttaaatgcctttcatcctttttggtattataatgattttaggagatgactttatgatcgatttatctgttccttctgatacattaggtctttttaattttaagcagtttgttaaaaaagacggtaaaaatacttttaaatatatcttctttgacaattacgactatatcattaatctacatgataaaggcaaactcagggatgtttcttttgataatgttcaaaaaactatcctttgttcttctatccatcttggttatgatctctttgtctgtcctaactgcggcaatgaaactattgttgctcatacctgcagttccagatactgtaccaaatgtggttctaaatccagtcaaagacgcgctgcttatgtcagctctatggcttttaaatccaaacatcgtcatatcgtctttaccatccctgctcagcttcgcttctactttatcaaaaaccgatcactgcttgatggtctttttgtcgttgccagaaatactctggcttcccttttcaacgacagaaaatatcgcagacaaaagcgtcttgaaaaaaagaaaggtatcttctatcataaaaaaagcaataaatctcaatatctttacaaagatacaactgataatgtgatctttggtgccattgcctcattgcacacttttggcagacctcttgactggaatccgcatatccatgttctggtatgcgaagatgcttatgattctaaagatgacaaaatcaaaaacttcagttatatggactataaaaaacttcgccagacatggcgttatcaattactcagctatcttgacagacacattggcaacgacaaagaatttcaaagccttaaaagctggttctaccgaaaatacgaggaagggttctatgtctatgctccaaaaatcaaagatgaacagactaaggacgacattgaaaaatgtgttcaatatataacccgttataccagcagaccaataatggctgaaagcaggatagtaaactatgatgatgataagaaaatgattcattggttctatcatcgtcatgaagataataagcgtgtagatgtcacagaatctgtttacagttttcttaacaaggtattgatgcactgtcctgaaaagaacttcaagatggtaagatattttggtttttattcaaataaatcaataaagacctataacaggatggctgaactgttgagccataaacaaaaaagagtagaagaactaaaaaatgacagaagggtgatgatagaaaagagacaaaaagagttacatttcagatataatatgataaaatcatttcaacgggatccattgctttgtgaatgtggagaaacaatggaatataaagaaagctatgaaccatttggtggaaacgataaaaatgacagagaatatcgtgaccgaaagattctcaaagcaaaatacagctatgagcataggaagaaggtaaacaagtgatcaatctgaccgatgaagaactagcagaattattaggggaaccagaggtaatgataccgatgaaatgtaagagatgtggttatgaagaagaagtaccggaatggatactagaagagtttttaggtgaagaaatatattcaggtaaagagaatcaaggatacagctgtcagtgtccaaaatgcaatggaagaatggttaggaaaaaatgatatttctaacacttttttagccacataaaaatatccagccaataaatgtacccttatgattggatatttttattttatacctaaacgaatcgaaattcctattagacaaaaaaagcccgagggctttatatagaataattattgacttgattgttagcttggtcaattagatcttgtagtgtaacactatcaacatattcttttatcaccttatccaatccctgccaaaaaggtaacgtaatacattcattacttcgtgaacaatgattaatatgatcttttaaacaagctataggtgcaagatcaccttctgtaattcttaaaatatcaccgataatatactcatcagggcgttttgttaagcgataacctccactattacctcttaaactctgtaaatatcccgccttatttaataatgatataatttgttcaagatacttgactgttaattcctgcctcatggcgatatctttcagcggtataaatttaccatcatcatgcatagcaatatccaacataaccctcaaagcataacgtcctttggttgaaattttcatttatgttcacctcgatataataatactgatattattcgataaatacaagcaaaattaatcatttatcttatcaattatgcaattatcatgcttttccaacaagaaacaatgttcagcattacctaatgtttctagaaaatcccctaaatcagtaggtgtaataactacatgatctaaaatattactcgtcttagttacctcgatgccaactgcctgcaaagcataatatacaagttcactacaatatagagtcgtatcatcataagtaatcatgctgtagtcataaggagttcctaaataatctagagcacgatcaatataacatttgataaactcattgtcttcgttaaatcgatagcctgaaagagccttgagataagactcttcttttaaatttgccatctgatcaaaagttctgattttaactcctgatgaattactatctaaaactaaaacttcattttgattttgataatgtttgattatatcttgataatatttatcatctggttggtaaaactctgtaaactgctgatatgtaccaagataaaaaactgtatgtttccatcttccaggaatagcatatgaacttaaataatttgtattttcaatatttatgatatcgccaactttaaaaatatttgtataatttaacagctcttcatattcaataacttcatcttttgctatagatgtactttcgacaacttcaatatgatcggctgtttcatttttaaaagagcagccacttatcattaatattaatactattaccaaaagaaattttttcatcaactcatcctttaatctttaatcatacttaaaccaacacgatgtttattaacatcaacatcaataacatatacttcaacaatgtctcctatacttagtttatccaaaggatgcttaattctttcatgtgaaattttagaaatgtgtactaaaccatcattttttaaaccaatatcaataaaagctccaaaatccacgacatttctaactgtaccttctaaagccattcctggttttaaatcctcaatttttaaaatatctttctttaaaagtggggttgcataattatctcttggtgaacgattcggtttaataaaactatcaattatatcatccaatgtataattatcgatttgtaattcctttatcgcctcttctttattaagatttgtaagtttatcagcaatctcttttgttcctagttctttttcatctgcacctattaattttaataattctttagcttgagtataattttcaggatgaatcgcagttgcatcgaatggatcattagcaccaggaattcgtaaaaatccaattgattgttgataagttttagctcctaatttattaacattttttatctcttcacggttagtaaatttaccatgttcatcacgatatttaataatatttttagctacgccactgttcaatccagaaacatattgcagtaaagaagcagacgctgtattaatatcaacaccaacactattaacagctttttcaacaacaaaatctaactgttcttcaagttgtttttgagctatatcatgctgatattgaccaacactgattgctttaggttcaatttttaccaattcagctaaaggatcttgtaatcttcgagctattgataccgcagaacgctcttctacttgataatctggaaattcttctttagcaagtttactagctgaataaaccgaagcaccagcttcagaaataattgcataatcaacatcaagattattttccttgattaatcgtgaaataaaagcttcactctctctactggcagttccgttaccaattgcgatgatttcaattttatatttcttaatgatatctaataacgtttttttatctttgtcataattatttttaggtatcgtaatgaatactttatcgatctttaatacttttcctgtttgatcaacaactgctaatttacaaccagtacgataagcaggatcaacacctaataccattttatcttttaatggcgcttgcataagtaacttttctaaattgattgaaaatacttttaatgcttgttcactagctttttctgttaattcattacgtacctcacgttcaattgaaggtaataacaaacgatttaagctatcttcaacagcttttaataaataatcattaacactactgtttctctttttagttacaccgcgatatatatattgaatcaaaaaatccttatccataacaatattaactgtaattactttttcattttcagcacgattaacagctaaaatacggtgtgaaacgattcgattaacacgttcatgataatcgtaatacatttcatatacttttgtttcatcgggatttttctttttaacttttgtttcaatcgtacctgatttatacatgatatctttaacaaatttacggtatttgatatcatcactaataacttcagcaataatatctaaagcaccttgaatcgcatcttcaatagtcgtcactttatcatttaaatattttttggcttcctcattaatatctcctttaggtaaagacaatatccatttacttaatggctctaaacctttagcttttgcttcagttgccttagtctttcttttttccttataaggtcgatataaatcttctacttcatttaatttagtagcttttaaaatatctgcttttaactgctctgttaacattcctttttcatctattaatctaataacatcttctttacgctttaacaaaccaacttgatattgataatacttatcaatatttctaatttggtcttcatctaagccacctgttgcttctttacgataacgcgcaataaagggaactgtatttccctgctctaataatgataaaactgcaactacttgtttttcagttatttccaattcttttgctgctattttaataatttcctcgttcataataactcctcttataattaaactttaactatattattttatccaaaattaataaaatatcaactcttatttaaaaaaaggaagctatcattatcaagcttccttcaaaatatcgttatttctttttctttttagataaatatgcaagcatacttaatgaagcagcaactcctaatgcagcatttaaattagtagtatcaccagtagcgacacttgctgttgtatctcctgcttttaccggattgctagtttcttttatttctacttgtaatcccgcaattgcttttgttaaaacatcttttacattatccacttgatcctgtgttgcttctggatcttctaatactaccttagcttcatttaaagcctctgcgactgctgcccatgttttagcactgtagtttgcagcgtttaagttatttgccttattgatcaattcttgtaataaatctttatttggttttaatcttaagttcaagaacgcttttactaattctgtaaaggcttcatctacttcaccttgcattgcgttaacatcagccaatacatcattagctttatctaatactggtaacatatcagaccatgatgattcaatgtatttactttcatctaatccattgatttgatctacttgtttttgtaacgcactcttatcacctttgtagaattctaacatatgcattacatttgctagtcgagcaaaagcactatctacttcactttgagtggcattagtttttgcatatacttcttttgcatttgttaaagcttcgttaaattcagttactactgctggtacgacattttctaagtcggctttttcagccatttcaatagcaatagctaataatgatttgtcagcatctttaacttcaactttaattaattgagcttcaagataattagctttaacaactatatctaatacttctctatttgatgttacattgtctatttgtgtttttaaaacagctaattcagaaacaaatgtttcccatgaatctgcagtataatcttcttctttcaatgcatctaatcttgcaattgtattttttgcatcacttatatcaatcaaagcatttttagcatttagtatttttgtataaacattatttaacatcgtttgagaaactaattcagcatctaataaagcctgagcttcatttacactagctaaaagttcatcaactgtcgttttagaatatctatctgtatctaatccactaacttcatttattaaatttgttaatgctgttttatcaccaggttcgatgacaccatcactatattcaaataagtttatttcagcaacagcacaactttgtttagctcctgtaccatatgcttcaagtactgttaatttaacatatagggcatctgtaggaacaaattctgcatattgaacatttttactatcttgccaagtacctgtagccactacgttgaattcttcaccatcgttacttacagaaatttcatattgtttaactctaccattactactattttgacgaggagtataagctaatttatataatttctttgtttcctctaattttagtgttactgattgaggtaaattaatatttgcatttccccaagttgaatgccaataagtatttggattattatcgataacattgcttgctgcaccatcagcattttcagctgtgctagaagaatgctgcgaagtataactatctaaagttatgccactattgatttgtgtaaaatcatgaatattagtatttaatgtaccaacttttccatttctaatgttttcaataataccatcattttcaacgatttcaacagctttcattacaccattaacttgttcagataatacagcttcaaatgtaatcgtatcacttcctgaaccagtttgataatcagccaaaataattttatcattgatacttaattttaattgtggattatttattgcaatcaattcttgatcaaatgtcaatgtaacattaatttttccattttcaacatttgtagaataactaataagttttggatctttcatctgttcagcaacagtccctgctgtaatgaaatcatcattgaattctgtatatttaatatcaaatgttccatcactatcatcttcgtaaagtaatccaaataaaacatcattttcatcattttgtaatatacttaaacaagaatattggaatttaccagtatttaaaatttggctattagtccatgtaatatctccggtttcttgatcaacttctccaatatgaaccataccttgtgttcttggataatgatctggatttgtcattacaacatattctttaccatctcgagtataatttactactgaaagctggcaataagtatcattgatttcggtcttttcaactttatcccaagtcattccaccatcactgcttgttgcaacataaaccttaccatagtaaacactatcataagtatttcgcatgaataatttaacttgtccgttatttaattgaatagcttgagattcggtaaacatctgactaccattattcattgtttcacggtcattaccttgtagtacttgtggtgattcacctaaagtccacgtttcaccaccatctttactaatgatcattgctgaagattggcttccactaacattagcactagcagtataaactggtactgctaaacttccatcttgtaattgaattccatttccaggacctgttccaataaacatcatccaatcttctttaacttgtggtgttatatcaactggatttgcccaagttttaccatcatcatcagaataagtcaaccatagatattgagtatttaaaatatgtaattcacctttatcaggtccatctttcaacatataaatattacctttatattctccatttaaataaaggcttccacgttcatgatatggtgcattaccttttaaaacaaccgtatatcccgtcttattattttggtcatcatatacataacccatatcaccatcaggacgaatcgtatactcgtttccttcactatcgaataattgttgataattaacaccatctatttctctatatccactacctgttgttaattgactagtatccattaaaccagatgtctctgggaacatatcaaccatcaagaaaatacgtcctgtttctttatcttcaaacatactactgtcaatcaagaaagatgaagatgaaggactattttgatttgagatcaaatctgcaataatgattggatcaccaaaatcatcttgtcctgcttcccttcttctaacagaaatatcaatatttccacagtcctgagatccagaattacgtttatcaatagcagctaaaactgttcctttagaagtcttcaacaatgaaggaatacgatatgaactagatccatcatatccagtatagaataaatcttctgtatctgtttttattgcattagtcatatcaacttcttggcctggctgccagtttgttagactatgttcttgactgattgcactagtatctaatacttcattatatgttttaacataatcaatcgcaccagcgaaagcttctaaatcatcatttgcagtatcaacaaaacctaagttaacagcattggcattacttaataaactaaagaatccttcagctacagcgctagtatattgatcaacaaatacaccatctaaataacacttaaaacctttaccactaccattttctttagtaatagtaatagtatgccatgctgtatcacttacggttctattcgctcttgtaattgaagatgatggcataacaaaatctttagttccttcaacgttaattccaaatgtattattactagggtttacataaacatcaatgtattcattcgctgcttcattatttgaaatagagaacaatgacattctttcagcactagcatcatttacgcgatatctgattgaaatacttcctgttgccattgatactatttgtgataatttatcattatcctgcactctttgcacatcagtatctttgtaataaacatttccatgctcataagcaacattttcaagagctcctaaatgataagacattatatcactttcatccaatgcactagtatatagttctaaattctttaaatttcctgtcattggataattattggctccacctgctctacttccaattccaaatcccatataattaggattattgataactccttgagtaaatccagatgatgttgttccctctaacacctttttgccatctaaataaacgcgataataaccattagcagtcatagtaaatgttactttatgttcagctgtaaaatccacatcactaagcgtaactttagaattgctaagcatttgtccacctgaggcatttcttaattctacccctaacgttttactgcttggaatagcatataatgaaaagtaattattagcagtggtattatcgccaataaagaaaatagagttaactccactattactattgctcgcaaaactaaatgttccattaatagtaaaatcatttagatttgcataattactgacatctccgctagcatcaatagcacctgtaccattatttacagtagtaatcgtatctgtagaatactgattagttggggcaactatactttctgcataaattggtactgtcatcaatggtgtcattacagatgtcgttcctaataatgaagccatcaagaccgaacagacaatcccttttttcatatctttatctcctcctttggcctatttttaaattttacttatattaagtaattatgtataggtatctataaaaatatgttatcattataatttagtaaagtatttataatatttaatgatttttttgtaaattttttactattttattattcattacatatctgcaattatattgatattatcgatatttttttattcaacaaattaaaatcatctatataattattactaaaatatttatcacttaataaaaataacaacattattagtaaaaaaaactaatatttatcaatttttacttaaaaaaagaaaaaatttattgcattgataaatcagtaatctttaaacgcccttatcgttattaactcatttcaaacaaagagcagcaatatattctttctttttatagatattaaaaataatacatttatagtttttactattttatttataatttttattatgagaaagtgcattataatactcttcaattgtatagataatatcattaaaaatttcactatctaataattctttagcctcttctattgaagcaaacaaataatcagtatgttcatcagaaagatgaacatgatcatttttaggaatgcataaataaccaattcctactgtttgataatcctctctaatcttagtaaatgtatacgcgggttttaaaataataatatctaatcctgtttcttcctttaattcacgaaccaaagcttgattaggtgtctcaccatattctaaaccaccccctggtagttcccaataacccaacccatcacttgagggttgaacccgttttaataataaaatttgattatttaatacgacaataccttttacagttatatgaaatcttacatttttcatcttctacctccgttaatcaactatatcataacattattattaataaaattgtttaatttttatcatcattagtgttataattatcacgaggtgatatttttatgatagattttaaatcagaagttttaaaaataaaagaccaaatgattgaagatataaaaaagttatgtgcaattccttcgatgcaagatgatagtactgttagtgaatttgcaccttttgggaaagctaatcgtgaagccttagatgcgatgttagaaattgggaaacgtgatggttttgaagttgaagacgttgacggttatgctggtcatatcgatatcggtgaaggtgatgaaacatttggaatacttggacatttagatgtcgttcctgtaaatgaagcaggttggaacagtgatccatttaatgttattattaaagatgacaaattatatggacgtggtgttgctgatgacaaaggtcctttattagctggatattatgctgctaaaattattaattcattaaacattcctacaaagatgaaaatcagggtcatttttggatgcaatgaagaactaggcagcagctgtgtcaaacactatttcacaaaaaaaccttatcctaaaatgggattcactcctgatgctgcttttcctgtagtttatggggaaaaagctggatgtggatttaagatcgagggtcatgtagaaaagggtggtctaatttacttatgtgctggtagcaggcctaatattgttcctgaaacatgtgaagctgtaattactggtaactataaacaatatgttgattcatatcgtaaatttttaagtgctaataacttaactggtgaaattgaagaagaaggaaatcatacaaaacttgttttaaaaggtaaatctgctcatgctagtactcctgacgaaggaataaatgcggttgttttactttgtaagtttctagcgactgtagttgataataaactagttgattttattttagaatatcttgatgattgtaatggtaaaaaactaggaattgatcatgttggtcttatgggacctttaactttaaatcttggtgtcatatcttattgtaaagaagagtttaaaatcacacttgatttacgttgtcctcatgatatggattttgaaggaatggttaataaatttcaaacagcatgcacaaattatggatttaaggaaacacatgatttaggtaaagcattatacattgatccagattctgatctaatcactaatttgcatagtgcctatgtaaatgttactggtgataatgttaataaaccacaagctattggtggtggaacttatgctaaatcaatgcctaattgtgttgcctttggtgccgaattccctaatgaagataatttgattcatggtaataatgaaaatattaaaattgagtctttattaaaagctacagaaatttattgttatgctttatataattcaattaaagtctagggtatactctagactttttattaataatctgataaactaattatacttgcagacatggcgaaattggtatacgcgctatcttgagggggtagtgggcaattgctcgtgcgagttcaaatctcgctgtctgcaccaatttttttaatttgccggtgtagttcaatggcagaacgcatgaatggtaatcatgaaattcaagttcgattcttggctccggcaccagtaaagataataaaaaaacggcaatgccgttttttatttttgttttttcttaatttcttccaattcatttaaatcataaggtgtcaactgatatacataatagtttaaccagttactaaaaagtaaatatgcatgcgaacgccacttcactaaaatcccattatgcatattatcatctttataataatttttaggcatggttgcctgattagatatcgcaagatcgcgcttgtattctttatctaaagtatctggatcatactcaggatgtcccgttacaaaaaaacgcgatccatctttttcagctattaaatatactcctgcttcatcactactagcaagaatatcaagatcatcaattttcgcaatatcttttgctgcaactgtcgtataacgcgaatgtggcgcataaaactgataatcaaaacctcgtaaaatttttcttttcatcttgtctacattagtatgatgaaaatacacacctgtcaatttttttttcaattcatatttttcaataccataaaaataatgaagtgccgcttgggaagcccaacaaataaaaaatgagctaaacacatgcgtttttgaccattctaagattttttccatctctggccaataatcaacatcttcaaatcttaatcgttcaactggagctccagttatgatcaaaccatcatatttattttctttaatatcatcaaaagttttataaaaagctaaaagatgttcttgagaagtatttttagaatcatgactagccatatgtatccaatcaacttctatttgcaaaggtgtatttgacaacattcttaataactgtgtttctgtaacgatcttagttggcataatatttaaaattaaaagctgtaatggtcttatctgctgtgctaatgctctattttcatccataacaaaaatattttcttctcttaagatcttacttgctggtaaatcatttggtattttaataggcataatatgcacctcctaatactgattagtttatcacatttaaactaagattttaagtaaatattaaaatgaaatcaattcattgaaaatctgaataatatattcatcagacattccagataaataatcaattatacttttaacaaaagccttatcatcttctaaaaaattatatacgatcttattttcatatatatctaaacgtttcattcccttcatacagctatatttttctaaccaatgaacataaccattaattgtatgtggaaaatcatttttatctttgattaattcgccaattatattagtgtcactgtctctattcaataattcatatttcataaagaaatcaaaaatagaattcaaaatcaattttacataattagcatgaatctgtactcgatcaattaaataaatattctgataattaaatttcataatcgttttcataatttcaaatgcttcatctgataaagaaattcccttttctggactactgtttttacaaacatcctgaataaaataatttactactgttccattattaatagcactaaactcataactaccactaatattatttaacgatgctcttaaaacctcaactttattttcttttaaaacttttaatcttaaagcatcttcgatatctcgtgccaaatatgcaattttatcagacattttaacaacacagccttcccatgtataaggattatataatccagcactagtaaactcatttaaatcaatatagtcatttcgtttaacaatatttttttgattcatttctccacaatgagaaattattccatcacgtactgcataagttaaattaagattatggcgatgatgcaaattatcttctaatgtttcaatatcatcaataaaatgtaaactattacgttcatgccaaaaagattctaaaccattatttttagcaagttcattaattatctgctcgccaccatgaccaaatggggcatggcctaaatcatgaccaacagaaattgctttagtaagttccgtatttaagcctaaataatttgcaattgtataactaattgattcaactaaattaacatgctcacttcgtgtacatacatgatcgtcttttactgcaaaaaaaacttgtgttttatgttttaaccgtcgataagcctgactaaaaataattctggtataatcacgcccaaattcacttcttagatcattttttctttgatataacggttctatccttgctgttgctttttgaaaatctggatgtttttcattcaaagcatagtctttaaataaattttttgtcatttcaatccccctatacagcatattatatgacagatttaatattttaacaaattttaaacatttgaacttcaatgtttttatctatagtcttcaattacttcaatattatttaaattattttttgaatttaaaataactattaaaaattatataccataaaatatcatgttaaatccaataaaaaaggaaagattagacatctttccctaaaatcaaattatttcgttaaaagtgatgcagcatccttatccaaaataactgtaacatcttgatgtttttgtaaaatacttgcaggtagttcttctgtaacaggaccttcgatcatccctttaactgcctcagcttttcccttaccaaaagctagtagtaaaacactttttgcattcatgatattactaatacccatacttaccgcctgctttggcacatcttcaatcttaccatcaaagaataatcgagcgttatcttcaatcgtactttgttttaaatcaacaacatgagtaactgcatcaaaagacgttcctggctcattaaaaccaatatgaccgtttgatccaattcctaataattgaatatcaattacattttctgccaaaagtttattatattcatcacaacttgcttgaatatcacctgacccttttggtacatgcacattttcaggtttaatgtccacttttgaaaataaatgtttttgcataaaataataataactttgaggatgagtatgttctaaaccataatattcatccaaattatacgatttaatgtctttataagaagtcccgttcttctcatgatcttcaaccattaattcgtacattttgactggcgtagatcccgtagccaatcctaaattagcagttggtttgtttttaataattcctaacattacttttgcagcttcagcgcttgcttcttcataattttcacaaataattagtttcatctttctgtccctccatcattatgatactatttttacccttaaacttcaagttaaagcttaaatttactaaatcttttcaaatagcacaatactatataaataagtatttacaacgttaagaaaaaagattaacctagcgacgatatttctttatttttcatataaaataaggtaaaataagaatgtatggaggtgtttttataatgataaaaggtattggggcatctaatggtatcgcaattgctaaagcctacaaattagttatgcccgatttaactgtaactaaagttacagtagaggatgtagaggctgaaatcaaaaaatttgatgaagctatggttcaaactgcaaaagaattagaagcaattaaagaagctgctgctaaaaatttatcagcagaagaagcagctgtctttgatgcacatgcattagttttacaagaccctgaattaaaaactcaagttgaagacaaaattaaaaatgaaaaagttaatgctgatgctgcattagatgaagttgctaatatgtttattgcaatgttcgaaagtatggacgataactattttaaagaaagagctgctgatattaaagatgtatctcgtcgtcttttagcaaatttacttggaaaatcattgccaaatcctgctttaatcgatgaagaagttgttattattgctgatgatttaactccttctgatactgctcaattaaataaaaacttagtcaaaggatttgcaactaatattggtggtagaacttctcactcagctattatggctcgttcattagaaattcctgctgttgtttcttgtaaaacaattacagaagaagttaatgaaaatgatatgatcgttttagatggtgaagcgggaattgttattttaaatcctagcgaagaagaaatcaaagaatatcaagttaaacgtgaagcattcattgcttataaagaagaattgaaaaaattaaagaatgaaaaatctgtaactttagatgatcatcatgttgaattagttgcaaatatcggatctccaaaagatattcaagctgttttagacaacggtggtgaaggtgttggtttatttagaactgaattcttatatatggaatctgctgaattaccaactgaagaacaacaatttgctgtttataaagaagtattagaaggtatgaatggaaaaccagttgttgttcgtacattagatattggtggagacaaaaaaatcgaagcccttcctttacctgaagaaatgaatccatttttaggagttagagctgttcgtttatgtttccaaagagaagatatttttagagtgcaattaagagcattacttagagcatcagtttatggtgatttaagaatcatgttccctatgatcgctacattagatgaatttagaaaagctaaaggaatcctattagaagaaaaagaaaaattagttaatgaaggtatttcagtatctgataatttccaagttggtatcatgattgaaattccagctgcagctgtattggctgatcaattagctaaagaagttgacttcttctcaatcggtacaaatgacttagttcaatatacatttgccgctgatagaatgtcttcaggtgtttcttatttatatcaacctttccacccatcaatcttacgtttagttaaacatgtaattgaatctgcacataatgaaggtaaatgggctggtatgtgtggtgaaatggctggtgaagctactgccgcaccattattgattggtttaggtttagatgaattctctatgtcagctacatcaatcctttcacaaagaaaattaattagatcaatgaaaaaatcagaaatgaatgaattagctgctaaagctattaattgctcaactatggaagaagtagttgctctagttaaagaatacgtagaattataattaaaacaaagattgttcttgcgtttttaagagtgaataaaatttcactcttttttatttaaaatttatggactaaaaaaccagaagtcaaattactgacttctggtttatatatattatctttattttacaaactttttatcctaaataggcttctcgaacttttggatcatttgctacatcattagcatcacccgaaatagtaatatttccagtctctaaaacatatgcgcgatcagcaattgataaagccttgttagcattttgttcaactaagaaaatagtgaccccatctttattgatttcttcaataatttcaaatatttcattgactaagataggtgacaatcccatagatggttcatctaataataataatttaggacgagacatcaatgctcttcccattgccagcatttgctgctcaccacctgataaagtgcctgccaattgacttttacgttctcctaaacgtggaaatcttttataaatattttctaaatctcttttaattcctattttatcagttcgaagatatgcacccatttcaagattatcagcaactgataactgggcaaaaatacggcgtccttctggtacttgtgctaagccattagcaataattttatgagcaggtatttttgtaatatttttattcataaaaactatatcaccagaagttacttttaataagccgcttaatgcatgcataatcgatgtttttcctgcaccattagcaccaatcaaagctactatttcaccttcattaacttcaaatgaaacatttttaactgcattgattactccataatgcacatttaatttatctacttttaacattttatcccccctactcatcattacctaaataagccgctattacatctggattcgacttgatttctgcaggtgttccaaaagcaataatcgttccaaaattcaacactgcgatcttatcacagattcccataaccagtttcatatcatgttcaatcaacaatatcgcaacatgaaatctttcacgaacaattttaattgtttccataagttctgctgtttccgtaggattcatacctgctgccggctcatctaacaataataatttaggtgaagtagctaatgctctggcaatttccagttttctttgtttaccatatggcaaattacaagcttttacatctgcaaacttttctaaatcgaatacttttaataattctattgccattttagtcattgtatcttcacctttaaaataattaggcaagtgtaagatactagtcattaatgaataattttgagaatgatgtaaaccaacttttacattatcaattacagtcatttccttaaataaacgaatattttggaaagtacgtgcgattcctaactgcgttattttagtaggcgataatttattaagtgatttccctgcaaaaacaattccaccactagtaggctgatatacaccagtaagtaaattaaagactgttgttttaccagcaccatttggtccaatcaaaccaaataattgattctcctcaatttcaaaattaaattcgtctactgcttttaaaccaccaaatttaacccctaaacctttagcttccaataatgccattttaagccacctccttatcttttagaaaaggaatgtgttttttcaaaaccttaaaaatatttttttcttttaaaatcatcgctgctatcaatactattgcatacaataacattcgatattgtgaaaaggctctaagatattctggtaaaatagtcatcacaattgcagcaataatagatcccttccaatttcccataccacctaaaacaacaatgactaaaatttcaactgatttattataatcaaaaacttttggtgaaatgacagaaatataatgggcatataatcctcctgctaatcctgcaaaaaaggctgagatcgcaaaagctaaaattttataataagtagttggtatacctgttaattcactagctgtctcatcttcacgaatggatacaattgcacgaccatgacgagactttacaattgaatagattacaaaaactgtaattgcagctgaaaaaaatacaattgtaaaattagtatttcgaggaattcctactaatccctttgatccattcgtaatatttaaattaaccataataactctaattatttcattaaaagcaagcgtaattatgcataaataatcacccttcaaacgtaaagtaggaataccaataatgattccaataattgtcgctataattgctccaatcaataaagaaccgataaaaggcatatccaaatgaatactgcataatgctgaaacataggctccaactgacataaacccagcgtgtcctaatgtcaattgtcctaaataacctgtagctaaattcaaggatgaagctaaaataatattaataccagcaatcattataattcctagccagtaattagaaattataccagccgacattaaagctgtcatagcaaaatataataagatagtgattacaaatgatattccgacattttttaattgtttattcatatcattcacctacactttctctcttacattacttccaaataaaccagcaggcttaacaagtaatataaatattaaaattccaaatacaacagcatcagaaaatgctgaagaaatatatgtaatcgtaaacgattcagcaataccaataacaattccaccaaccatggcaccttgaatacttccaataccgccaagtactgcagcgataaaagccttgattcctaacattgcacctatatatggattaatcaatgaaaacttagtaccatagataacaccagcaatcgcagccaatgctgaaccaatagcaaatgttaaagcaattgtagtatcaacatttattcccattaactgtgctgctttaccatcctcacttacagcacgcatcgctttacctaattttgttttattgacaaaaaacaataataaagcagttgaaattgctgtaatgatcaaagttgcaattgttacataagacatcgtaatggaacctaaactaattgttccagaaggaataatttttggaaaagttaaagaagcagatccaaaaataattaaaaaaacattttgtaataaataacttaccccgattgctgtgatcaataccgttaaagaacccgcaccacgcaatggacgataagcaacccgttcagttactacccctaaaacagcacaaccgataatagatatagcaaccgcaataaacatcggtaaacccaaaagtgacatacatacatatgttatataagcaccaaccataataatttcaccatgagcaaagtttatcattttagctattccatataccattgtatatccaactgctacaagagcatacatacttccagtactaagaccgttaattatttgttctaaaaaatccatttctatcacctctttattctaaaaaagcaataggagaaaaagtttctccaattgcttttaaatatctaaaattaatgagaacttgttacatactgaccattttcaaatccaacaataaccatctctttaattggattgtgtttatcatcatatttaaatgctcccgcaacaccattcttataatcagttttagctaattcttcattaactttagaagcttctgtagttccggctctttccattgcttccatcattacaaaaacagaatcataagcaaatgctgcaaacatatttggttcagatttatatttttctttataagctttaacaaatttttgaacattttcatcagaagatcctttgtcaaaaccacttgtataatagcatccatcaaatatatttccatttacacctttaacacctagaactccgtcccatccatcagcaccaagtaatggattattgataccagcatcgcggaattgttgaacgattgttacaacttgttcataataatctggtaaaaatacagtatcaaattcttttcctttcaatttagaaatatatgttgaataatctttagtatcttttgtataagtttcatcaaatactatttcaacattttgatttttagcttcttcaacaaacgcatctcttaaaccagttgaataatctgaatctttgttagataaaatagcaacttttttataattaaattcagttccacatttctttgctaagaaagttcctgcataagaatcgttagtacagattctaaacacgttttcatatgtttcacctttatcattgatagtaatttgatctgctgatcctgatggcgttaaaattggtgttccatcagcttcagcagtagcaactacagccaaagcagatcctgaagttactgaaccaataattgcattgacaccttcctcagttactaatttgttataagcattgactccttcagttgcatcagctttatcatctaaataaacagcagatacgttagcatcattagcactgttgtattcatcaatagccaattcaatagcattctttacagctgtcccatattgtgaagcatcacctgataaaggaccaataaatcctaattttgcctcacttacttttgttgcagagtttccccctccgccaccgcatgctactaacatacttgctacagataacgtagcaacaatttttttaaatcttgaataattatttttcataagtacatcccctctaagattaatataattctatcataccattaattaagaatatgtcaattaaaatgtatttttttgtaaaataaacaaaaattcacctataaataagaaattttctaaatttaaaataaaaccaataacatttgtatccatgtataaacaaaaaaaggatacccgaggtatccaaaataaaaaaagaaccggcagcttgctattttcgcaccgcagtactatcttcgccgttatgatgcttaacttctgtgttcggtatgggtacaggtgtgtccatcatgctatcgctaccagatctcttctctttaagcaattcctttcgagaatcactcaaaaccggataatagttccttccatttgctcgtctccaaccttctctttaggttaagtcctcgacctattagtatcagtccgcttaacatgtcgccatgcttacactcctgacctatctaccttatcgtctttaaggggtcttactcacttgcgttttgggaagtctcatcttgaagtgggtttcacacttagatgccttcagcgtttatcccttccatatttagctacccagctgtgccactggcgtgacaactggtgcaccattgatatgtccatcccggtcctctcgtactgaggacagatcttctcaaacttcctacgcccacgacagatagggaccgaactgtctcacgacgttctgaacccagctcgcgtaccgctttaatgggcgaacagcccaacccttggaaccgacttcagctccaggatgcgatgagccgacatcgaggtgccaaacctccccgtcgatgtgaactcttgggggagatcagcctgttatccccagggtagcttttatccgttgagcgacggcctttccattcagcaccgccggatcactaagcccgactttcgtccctgctcgacttgttggtctcgcagtcaaacacccttttgcctttgcactctgcgcttgatttccatccaagctgagggtatctttgggcgcctccgttactctttgggaggcgaccgccccagtcaaactgcccacctgacactgtcccgtcaccagtttatggcatccggttagaactccaatacacgaagagtagtatcccaacagcgactcctcacacactggcgtgcatgtctcttcgtctcctacctatcctgtacatcctgcatcaaagtccaatatcaagctgcagtaaagctccatggggtctttccgtctagtcgcgggtaacctgcatcttcacaggtactaagacttcaccgagtctacagctgagacagcgcccaaatcgttacgcctttcgtgcgggtcagaacttacctgacaaggaatttcgctaccttaggaccgttatagttacggccgccgtttactggggcttcaattcagtgcttcgcttgcgctgacacatcctcttaaccttccagcaccgggcaggcgtcaccccatatacgtcgtctttcgacttagcatagagctgtgtttttggtaaacagtcgcttgggccgtttcactgcggctcatatctctatgagcactccttctccctaagttacggagtcattttgcagagttccttagctatagttctctcgctcaccttaggattctctcctcacccatgtgtgtccattttcggtacgggttactgtatgattagcactagaagcttttcttggaagcttgcttcacgctcttctgtactcgccttagctttccatccgcttcacgccttcgcctttcgacaaccggatttgcctggttgtcagctacctcgcttgcacctgcttttccagctccaggatgcgctagcctgctccgtcactccttcattcataccgtaagtacaggaatctctacctgttgtccatcgactacgcctctcggcctcgccttaggtcccgacttacccagagcggacgaaccttcctctggaaaccttgggttttcggtgcgcgggattctcacccgcgttccgctactcacaccggcattctctcttctatacgctccactgctccttccggtacagcttctccgcctatagaacgctcccctaccacttacatctctgtaaatccatagcttcggtaatatacttagccccggtaaattatcggcgcagagtcattcgactagtgagctgttacgcactctttaaaggatggctgcttctgagccaacctcctagttgtctggacatctccacatccttttccacttagtatatattttgggaccttagctgatggtctgggctgtttcccttttgacagtggaccttatcacccgctgtctgactgccgagcctgtctctgtgacattcggagtttgattatattcagtaccccgggatggggccatcacatattcagtgctctaccttcacttgacctctctctcgacgctagccctaaagctatttcggggagaaccagctatctccgagttcgattggaatttcacccctagccacaactcatccgccaacgtttcaacgggggtcggttcggtcctccatcgggttctaccccaacttcaacctggtcatggctagatcactcggtttcgggtctacgacatgcaactttcgccctcttaagactcgctttcgcttcggctccgcatatcctgcttaacctcgctccatatcgtaactcgccggttcattctacaaaaggcacgctatcaccctttaacgggctctaacttcttgtaagcatatggtttcaggttctctttcactcccctcccggggttcttttcacctttccctcacggtactggttcactatcggtcacagagtagtatttagccttgccagatggtcctggctgattccgacaggattcctcgtgtcccgccgtactcaggtgctgtctcaagcttcctcactatttcgactacggggctctcaccctgtttcgccggacttcccattccgttcgtctataatgtcttcttgctctttctcgacagtccttcaaccccgatccttggatcggtttgggctcctcccctttcgctcgccactacttagggaatcatttctttattttctcttccttcaggtacttagatgtttcagttccctgagtctcacctctctgaagctattttttcacttcaggatacccggtctctactccgggtgggttcccccattcggatatcgacggctcttcgcatgcttactgcttaccgtcgcatttcgctgtttgctgcgtccttcttcgcctctctgtgcctaggcatccgccatacgctctttcttactttacctattggtgttcttgatcactttactatttactttcgtctcttcagtgattcttttcttagttttcgacttctctagaaagacctcaataatcttcttatctcgatctcttcttttctatcgcaaatttcttctattatccagttttcaatgatctcttttaagcaatactcctcctgagcatcactcaaaactaaacagtattaatgaaacttcacttctcttctttctccttagaaaggaggtgatccatccccacgttcccgtagggataccttgttacgacttcaccccaatcatcaatcccaccttagacagctccctccttgcggttaggccaccggcttcgggtgttatcaactctcatggtgtgacgggcggtgtgtacaaggcccgagaacgtattcaccgcgacatgctgattcgcgattactagcgattccaacttcatgtagtcgagttgcagactacaatccgaactgagaatggttttctgggtttcgctccacctcgcggcttcgcttccctctgctccatccattgtagcacgtgtgtagcccaggtcataaggggcatgatgatttgacgtcatccccgccttcctccagcttgtcactggcagtctcgctagagtccccaacttaatgatggtaactaacgataagggttgcgctcgttgcgggacttaacccaacatctcacgacacgagctgacgacaaccatgcaccacctgtatcccatatatctatctctccatctctggagcctttatgagtatgtcaagacctggtaaggttcttcgcgttgcttcgaattaaaccacatgctccaccgcttgtgcgggcccccgtcaattcctttgagtttcattcttgcgaacgtactactcaggcggagtacttactgcgttaactgcagcactgagatttgactcccaacacttagtactcatcgtttacggcgtggactactagggtatctaatcctatttgctccccacgctttcgggactgagcgtcagttgcaggccagatcgtcgccttcgccactggtgttcctccatatatctacgcatttcaccgctacacatggaattccacgatcctctcctgcactctagctgcccggtttctatggcttactgaagttaagcttcagtctttcaccacagacccttgctgccgcctgctccctctttacgcccaataattccggataacgcttgccacctacgtattaccgcggctgctggcacgtagttagccgtggcttcctcataaagtaccgtcactcggataccattccctgtatccgcctttcttcctttataacagaagtttacagtccgaagaccttcctccttcacgcggcgttgctcggtcagggttccccccattgccgaaaattccctactgctgcctcccgtaggagtctgggccgtgtctcagtcccagtgtggccggtcaccctctcaggtcggctacgcatcgtcgccttggtgagccgttacctcaccaactagctaatgcgccataagtccatcctctaccagtgccttggcacttttaataaacttaccatgcggtatctttacctatgcggtcttagctatcgtttccaatagttatccccctgtaaagggcaggttacttatgtattactcacccgttcgccactcgggcattgctgcccgcgttcgacttgcatgtattaggcacgccgccagcgttcatcctgagccaggatcaaactctccattgtctctttatctttacaatctttcgtttgtttagctcttctttttctcttctatccgtttccggatccttctttgacgtgtgtttcttaattctgtttagttttcaatgatctctccggcttctttcgccgactcgattatcttacactcttttctctttttagtcaatcttttttttacttttttttctttttcttcgggttactttatcccttctcttgagtgcctccttaatttaccatatctctccctctttgtaaataccttttttcctcttttttctttttttattgccattttaaacaaaaatgatgaacatagtccatcattaaaaaatttctttgctatccaagataatcgttacaggcccatcatttattagtgatacttccatcatcgccccaaaaactcctcgttctactttaactccttttttttccaacattttattaaaataatcatataaaggacttgatacatctggcttagctgcatctatgaaacttggtcttcttccttttttacaatttgcatatagagtaaattgtgaaatcgacaagatactgccgtttacatctaatagtgataaattcaatttatcattttcatcttcaaaaattcttaaatttactaatttatcaaccatcttttcaactagcgtttcatcatcaccatttgtaattcctactaaaaccatatagcctttttcaattgctccaactatcttaccatcaatcttaacactactttgactcactttttggataaccaatctcattttaaatcacctatctttcactatctaaaaatgttataatcattataactgattttaaaaacgaaaggaagttaatatgtcatcaacacttgcaaatagaatgcgccctaaaaatttatgtgatatcattggtcaacaacacttaatcggtccaaaagctattttaactaaatttgtaactaaaaatcatcctttttcaatcatattatatggtaatcccggctgtggcaagacaactattgctatggctttagctaatgatcttaacataccatatcgaatctttaatgcttcaacgggaaataaaaaggaaatggatgctattattgaagaagccaaactaagcaatggtctttttgttattattgatgaagttcatcgtctaaataaagcccgtcaggatgatcttctttctcatatggaaagtggtttattaataattgctggatgtacgactgctaatccttttcattcaattaatccagcaattcgttcacgctgtcatatccttgaagtcaaaccattgacaactgctgaaatcatcgatggtttaaataaggcgatgatctcacccgatggattaaataacgaatatacaattgaagacgaagctttatatagtatcgctaaattaagtagcggagatattcgttacggctacaactgtttagaaatttgttctattgtttgtgaaaaaaaccatattactatgaatgatctaaaaaccgctgctattaaaactaatgttatctatgataaagacgaagataattattatgatactttaagtggtttacaaaaatcaattcgtggcagcgatcccaatggggctatgtattattttgcaaaactaatcgaatctaacgatattgaatcattagaaaggcgtttaattacaaccgcttatgaagatattggtttagctaatcctaatgcctgtatgcgaacagttatcgctttacaggcagcaaaaacaattggttttcctgaagcaagaattccaattgccagtgcaatcattgatctttgtttatcacctaaatctaaatcaagtgaaaatgccattgatcgagctatggcatctttaaatgagcattcattcaaaacacctgattatctgcgcttgactcctattggtttgacagatgatgaaaaatatgattataatcgacctgaattatgggaatatattcaatatcttcctcaagaattaggtaacatgcaattttatattccctggatgacaagtaattatgaaaaagcattagcagaaaattatcggcgaatcttaaaacatggacgtactagtaatataaaaaaattaaatcagcaaaaaaataagtgatttttatatttttcactatcttttataaacttagagaaaaattaaattatacttatgttggataaatcaagaaattttttcttaataataataatactttcaatcactatagctcataacaataaaataaacagcttttttagtaactttcaaaactatttcatcaaacaaaaacatcaaggatagaaatcagatttctcttgatgttttttatactattcattgttaattaaatcatcaattaccatactaattgtttcatcaaaatcattcaaattaactttaaaccattcaacaggtaattgattattaaaccatgtatattgtcttttagcataattacgagaattttttttgatcaactctaaagtttcttcaagactttgatttccttgaaaatatgcaaaccattctttataaccgattgctttcatactctgaagagaagaagaataattttttttcatcaatttttcaatttcctgatataaaccttgttccatcatcagatctacccgctgattgattcgctcatataacacatctcgctctaaagtaagaccaataaatctagcatcataaatcaattcatgattttgtttagctaaagtctcgctttttttcactccggtactttcatatattgcaattgcccgaagtacccgctgacgattattaggatgtaattctttggcactcgcttcatcaattttaagtaataaatcatataattgctcattagtatgatcctgatatttatttacatactcttgatgatccatttggctttcaccaaattcatagtcataaagagccgcttttatatacaaccctgtacccccaacaataattggtaatttgccacgactgctgatttctttgatttttagcctaacctcatcttgaaaatccttaacactataactttccgtcggttctttaatattgatcaaatgatgtttaacaccttccatttcagcaactgttacttttgctgttccaatatccatcgttttataaatctgcattgaatcgccactaattacttcaccattaaaatatttagcaagcgctacccccatttttgttttaccaacccctgttggtccaactattacgattactttttccattatcctacccgcttaaataatttttcaatttcatatgtagaatagtaaatgatcgttggtctgccatggggacaaacatagggattatcacaacgcattaaattatcaattatattttgcattccttcgtttgataaatgggtattggcttttaatgatgctttacaacttaatgttgcaattgcatgatcttgtaatttaactacatcaactttattatcatttaataactgcgttaccatatcttcgataaatacatgctcatcaatattttgcatccataatggtaattgtttgatcacataactgccactaccaaaaacctctaaattaattcctaactgtgctaacatttcttttctttcttcaataatcaaaaattcacttaaaggatattctaaagtaatcggcactaacaaatcacgcattgataaatcaagattttgatatttttctaaataatattcgtaattgatccgttcttgaccagcatgttgatcaacaatatacattcccgtttcatcttcacaaataatataagttccatgaacctgacctttaacaaacaatttctttttcatcagtttctctcttggttcgactttagtttcaattatttgttgatcagggataatatagtcatcatttttttccgcaactatttttaaatcttctttactatcgttaaaaacttgtttttgataaactgttttttttgaatcctcaacattagttctttcagtatttatgagcggatcattttcatagcttaattcaagttctacctgtgttaaatcaggaacaaatttcggtttattcaacactggagcttcatatgtcaaatttattttagctaaggcatcactaattccctggtatactaactctttaagtttcatctctttggaaaaacggacttccaatttagatgggtgaacattgacatcgactaaaaaaggatcaatttcaatattaacgattgcaatcggaaaacgtttatcggcaagataacgtcgataagcattattaatgctgtctactgtgattttatttttaacgattcgggaattgaccatcgtcacgatatgatttttactagcacgattaatatctatctttgatatataaccggtaacatgaaattcatcatcttcaaaatcaactgcaatcatatttttcgccacatttagtccatatacattagaaataacttctaataaattaccattaccattagttttatagatcattcttccattatgcactaatgaaaaggcaatttggggatgcgagagtgataagcgctctaaatatgtttgaatattggcaaattcagcattgatcgacttaacatactttaaccgagcgggaacattttgaaataatttttttactttgatattggttccttttttacaatcactatcctcacatttaatatatttaccatactgataatttaccgttgttcctttttcaccaatactagtttttaattcaaagtcactaattgacgcaattgaaggaattgcttcaccacgaaagcctaaagtttgaatacaaaacaaatcctgatcatctttgattttacttgtcgcatgacgactaaaacataacaaagcatcttctttgatcattccctcaccattatcaatgacctgaatcaaattcaaaccgccctcttcaataataacatctattttactactatttgcatcaatgctattttcaactaattcttttacaacattggcaggtcgttcaattacctcacctgctgcaatcttattggctaaaacatcatcaagctgtctaattttttgcaaacatatcacctgctttcatttaatttctttaattctatcaatgttgataaagcatccaaaggcgacaatgtcattggatcaataccatcaagatatttttctacaacactcgttgaaactactggtacttcttttaaggtttcatcacttaaatgatgttcaatattattctcttctaaagcttctaataaaacattggcacgatttaagataacatctggtaatcttgctagttttgcaacattgattccatatgatttatttgagcgtcccggcttgatgcgatataaaaatactagattatcattttttatcgaagcacttgcatgaacatttttgattcctagatctttttcttctaaaaatgttaattcatgataatgagtcgaaaataaagtaatacatttaatcgaactagcaatatattcaatcattgcctgggcaatagccataccatcaaaagttgctgtcccgcgtccaatttcatcgaaaataatcaacgaattttccgttgcataacgtaaagcattattagcttcaagcatttctaccataaatgtcgactgaccagaaattaaatcatcactagccccgatacgcgtaaaaatttgatcaaaaatcgggatattagcctcgctgcatggtacaaaacaaccgatctgtgccattaaagcaattagtgcaatttggcgcatataagttgatttaccacccatattaggcccagtaatcaataaaaccggatgatcatgatcgatttcaacatcattagatacataagttccttgagccattactctttcaataacgccatgacgcccatcaacaactttgaaaatcttctcttgattaaatattggccgaacatagctattttcacttgaaatcacagccattgattggtaaacatcgactttagcaacgacttttgccacatcttgaagtatatgcacatcttttttgatataatctctgatttgtgtaaacaagacatattcaagcttgaccattttatcttgggcgcttaatagtttcgattccatttcttttaattcaggggtcacaaatcgttctgcattagctaaactttgtttacgagtataattaaactcatcttttattaatgataaataactttttgttacttcaatatagtaaccaaaaactcggttataaccaatttttaatcccttgatccccgttttatcacgctctttttgttcaaagtttgctagccactgcttcccatgatcacgaatatatcttaattcatctaattcttcattaaaaccatctttaatgatcccaccttcttttactgttaaaggcggattgtcaacgatagcattatcaattagttctgttatatgctttaaatcaactagtttgttggctaattcatcaagtaatggttcatccaaagaaactaattgggcttttaattctggtaaaacctttaaagaactgctgatccattttaaatctcgagcatttatattgccaaaagcaattcgtgaagacagcctttcaagatcataaatatctttcaaaatttctttaacactttctctttgaataaagtatttagtaaaaatttcgactatatctaaacgttcttcgatttgtgcttgattaattaggggtcgttcgatccactgtttcaataatcttgaacccattgctgtttttgtctgatctaacaaccaatataaacttccatatttatcattatttttagtattgatcgttaattctaaagcttttttggtatacatatccattgttaaaaaatcatcattattgatttcttcaattacctgaagatgctctaattctcttttttgcgtatctaataaataattcaataataaagatgctgtttttatctgttttaaatctttgatcttactaaatatcttatcatatttttcgttgtacttatcattatcaaatggcgataataaaatatcatcaaattcataactttgattagacaaacatactatttctttaaccgccattgactgtagttgatttaataaaagtttttcttttttatcaatattaacaacactaaattcgccggtagagatatcacaaaaagctaatgtataattaaaatcaaattcttctaatgaggcaatataattatttctattatttgtcaacgattcatcaaatattgttcctggtgtaatgatttgaactacgccacgttcgactattccttttttgcctggttccgttaactgttcaacgattgcaacccgatgaccattatcaactaacttttgaatataactagcagctgaatgatatggtactccacacatcggcactctttctgccacaccagcattcttgcctgtcaatgctatttccagctctttggaaacaagaatggcatcatcaaaaaacatttcataaaaatcacctaatctaaacattacgattgaatcttgattttcttcttttatcgataaatactgcatcatcattggactatatttaggtttcatatactaactccacttctaaaaaattactatcacattataacacaactctttacaaaagaaaaaaggcttacgccttcatttaataaaattttcatcaacagtaatattatcaatttcatcccatgactctttttcattctttgtttctactttcattgttgttttaccaatcacacttaaagaaatttctttttcaatctctatcaaaacacattcatcagtcttatttacactgatacattttggttcgcgattgcaaacaaccattaattcatcattctcattaaagtttcgactctcttttttaactagatccaattcattcatataacttactgtctgtttcaaaacgttgctgtcatcattataactataccataaatgaacatcgaaagttcctaaaacgatcggctgtccttttttaaaggtagcattatagcgatgatttgcaatccagcacccaagaattttgtcataattttcaattacaaacggatatttattaagagttctttttttccctttagcaataactgcctgggtaataatttcacgaatattatttgccatgttctcacctattttaatatatgcaagaatctaaaaaaatgtacaaaaaactcaataataaaagaagatacatgacctgtatcttctaattttgatgtccatttcctgatgatgagtctttcaaaataacatcatgtgcaccaccttcaacaatactagttgaagatacaagtgtgattttagcttttttctgtaattcagaaatagttaaagccccacaattacacattgttgatttaattttacttaaagttaatcccacattatcttttaagctaccagcatatggtacatatgaatcaacaccttcttcaaatgaaagttttgcatcaccacccatatcataacgctgccagttacgagctcgagccgaaccttcaccccagtattctttcatatactgaccattgatacttaccttattagttggtgattcatcgaatcttgaaaaatatctacctaacataataaaatctgatcccattgctaatgctagtgtcatatgataatcgtgaacgattccaccatcagaacaaattggcacataaactccagtttcttcaaaatattcatcacgagctttagctacttcaatcgttgctgttgcctgaccacgtccaattcctttttgttcacgagtgatacaaatagatccaccaccaataccaactttaacaaaatcagccccagcttcagctaagaatctaaatccttcagcatcaacaacatttccagcaccgactttaacactatcaccataatgctctctgatccagtcaattgtaattttttgccattctgtaaatccttcagatgaatcaatacataatacgtctacacccgcttctattaaagctggtactcgttcagcaaaatcacgggtattgatccccgctccaacaacatagcgttttgaatcatctaataactcattgggattagattttcttgtttcatagtcttttctaaaaacaaaatatgccaatttttgatcatcatcaataattggtaaagcattaagcttattatcccaaataagatcatttgcttcttttaaagtaattcccgtatgaccacagatcaatttatcaaacggtgtcataaattcagtaacttttgtatttaatccagttcttgaaacacggtaatctctacctgttacgattcctaataatttaccattagcactaccatcttctgttactgccatcgttgaatgcccagttttttcttttaaagcaataacatcagccaatgtatcactaacactcaaattagaatcacttggtacaaaacctgctttataagttttagcgcgtttaaccatagctgcttgatcttcgatagtttgtgatccataaataaatgataccccgccttctcttgcaagggctactgccattctatcatcagatactgcctgcattactgctgaaactaaaggaatatttaatgataatgctggttcttcaccttttttaaatttaactaaaggggtttttaaactaacgtttttagtttgacactctgtagatgaatatcctggtaccaaaagatattcgttaaatgtatgcgatggttcatcaaaaaaatatgccattttgcgtctccttttcttcattttttctgtttgattttcataaattataaataggattgacagttaagtcaacccttattttaataattgtccatttatgtaactatttataaattgtaaaatctcatttacttcttcttttaaataaagataattaacaactatcggattattttcaaactcagcttttaacttttgatattcatcaatcgttttaataactgtttcatcctgattagctttttgattaacgatttttttttgataagcttttatttttgtttctaattttttaatttcattatcttgatcgatcaatcgttcatatttttgatattctttgattacttcaagatttaataaataatcatttaactctttagcataatcaaaactattcaaccgcttcaccctttaatgcccatgttttagcttcagtaatctttactttaatgatctttccaatatcttttgaatcacccttaaaattaaccagcttttgatgtcttgtatatcctgtcaacattgaatcatccttttttgaagttccttcaactaacacttcaacaatttcatttaaaaaccgctggttttgtttataggctttttcattgacgatttcatttaatttatataaacgctgatctttttcttcacttgatacattatcaaccattttagctgctggtgttccagctcgcggagaataaacaaacgtataagctaaatcatattcacactcttgatatagtgataaagtatctaaatattgttcatgagtctcatttggaaatcccacaataatatccgttgtaactgtgcaatccggtatgtattctttaattttatgaaataactcaagatattgctcacgactataacgacgacccattaattttagcacctcattgttacctgattgtaccggtaaatgaatcgccggcataatattatcatatttagcaatgattttgatcatctcttcactaaaatcccaaggatgacttgtcgtaaaacggattcttgggattttcgttttagccacatcttcgagtaaatttgaaaagctataatcatcacctagatctttaccatagctattaacattttgtcctaaaagagtaatttcctgataaccatcagcaaccaacccttctacttctttgataatatctttcgctaaacgcgaacgctctttaccccgagtataagggacaatacagtatgtacaaaacttattgcagccatacataatatttacccatgctttgtattttttttcacgacgaacgggagcattttcaattacatcgccttctttagaccagacttcaacaaccatttccttactataaagcgcctcttttaataattctggtaaacgatggatattatgtgttccaaaaatcaaatcaacatgaggatgtttttctaaaatccgattaacaacaacttcttcttgcgccatacagccgcacattgcaaaaattaaatccggattagtttttttcaaatttttcacatatccaactttaccaaatactttctcttcagcattttctctaattgcacaagtatttaaaataattacatcagcctctttgatttctgttgttggctgatatgacatactttctaaaatacccgataatgtttcactatctctttcattggcttgacaaccatatgtttgaatataatattttttaccaataccagctttaaccatatctaaaggaacatgatatgcatcatcatatcgccttacttgatcacgacttcttctttttgcttcatttaatgaaggttttttaaaataactactataatctttcatttgttcaccacttttctaacatattatatacataaattatcaacatttccacaaaaaaataaggactgaatgtccttattatctaaaaatccattcagctaaactcaaaacggtcttataaataaattattttgaccttaatttcagcattatttcttatttttaacaaatttacagctaatgaatcactttaattccaataacaatctaatcgctgtaatttccttatcctcaacgatcaaatcatgaaatgaaggaatacaaacgatttcatttcctgtaggaataatatatcccctggcaatagctaccgcttttatcgcttgattcaaagctgccgcaccaataacttgaatctgcaatttagattcatttctaatcatactagcaatagccccagcaacactattagggctagacgatgatgatactttgattgtttccatatttttgcctcctaatcaactatatgaaaacccaaagaaattatacctaaatataaggatgatcttgattaattaatattctttcgatttttactggcacatttttctcaaaagttaaaattacccctgataattgccccgtacttttcgctaccataaaaggtgctccaaaacctcgtaatcttgttacaatagcatctaagtcacagccaatcgcactcatataaggtcctgtcatccctacatcactaataaaagccagcttcccatcaattattttttcatcagctgtctgtacatgggtatgagtacctagaacagcaccattaactcgatctttaacataatgagcaaaagctatcttttcgcttgttgtttctccatgaaaatcaataatatgaatatcttgagataaccctaaataatcatcaataacttcaaaaggattactattacgattatccataaaagccgaccctaaaacattggtcacccgtatctttttatttaaaacatcaaatacccgtgatttaactcctggcaacactttaggctgattaactgggacaattaatttatctgcttcatcaatataatcatataattcttttttatcaaaagtatgatttcccatcgtcattgcctggatcccttgaaacaacaattcatcataatgtctctttaacaacccttttccatgactggtattttcaacattagcaataacaaaatcaatctgatgatctttaactagtcgatgcaaataatcagctaccatctctcgaccaatttcaccaaatatatctccaataaataatattttcattttcattccctttcatataaaaggataggctaagcctatcctatttatttagctacttcactagctcgtacctcacgaatcactgtaactttgatatgccctggatatgtaagttcttcttcaatcttagttttaatatctcgagcaattttatgagacattaaatcatcaactttatccggtttaacaacaattcgaatttcacgtcctgcttgaattgcaaacacacgatcaacgccatcaaaactttttgccatttcttcaagtttttctaaacgttgaatataattttcaatcgtttcactgcgacttcctgggcgagccgcacttaaagtatcagcagcagctaccaaaattgaaataacactagttgccggaacatcaccatgatgtgactcgattgcatttacaactactggatgttctccatgttttttagcatatttagcacctaattcaacatggcttccctgcatttcatgatcgattgcttttcctaaatcatgtaataacccagcccgtcgtgctaattgctggttcaatcctaattcagctgccatgattccagccaaatgagctacttctaaagaatgctgtaaagcgttttgaccgtaactagtacgatatttaagttttcctaacatcatcacgatatctttatcaattctagaaatacccaattcaaatattgcatcttcaccagtttttctaattacttcatttagttcattttttgttttttgaacaacttcttcaattcttcctggctgaattcgtccatcacgaatcaacgtttctaatgataatcttgcaatttcacgacgaacaggatcaaaacatgaaattgtaatcgcttccggagtatcatcaatgattaaatctactcccgtagtttgttcgattgctttaatattccggccttcgcgtccaatgattcttcccttcatctcttcacttggtaaagcaactaccgaaactgttctttctactgtttcttcttgagcataacgattaattgcatttgcaattatatcacgagaaagcatactggctttagactttgcttcctcttcctgctctttaatataggctgtcatttctgtagcagtttgttgttcaacctgtttgaacaattcttgcttagcttcatttgctgacatcgcagcaattttctctaattcgccaactttggcatcaattttttcttttaattcagcttctagtttccctagtctggcttctctttcgtctaattgtactactttttgcgctaaaacatcttctcttccctgaatagcaatatctcttcgatcaattgtctgttccctttgtaaaagtttattttcaagttcattaatctcttgtctttgttgctttgcttctttttcagcaagtagttttaactcataagcttctgtcttagcatctaaaatcgcttctttaacaagattatctgctttaacagttgcttcatctataatttttgcagcacttacgtttgctttagaaatttttagtttgttaatgaaatagtcaataaaaaaacctaaagctacagctagaacataggttaaaatagaaacggcattaattcctgacattatttgccctccattttcttctatgtagtttatttttatgaatatatgtattcattgcgccaaaggcacaatagtattgtataatattttcagtttatttacaatgaaaactatttttacttaattttttttctttaaatatcctgagcaatttttttgttgattatacgcagatattttattagaattaaaatatctttgattttatcaaacaaaaaaagatagcggtatcatttttaaatagtcatgtacatgatactagatgatatgataaaataaataagaaatgaggtaataaaatggcaaaaacattaattttagctgaaaagccatcagtaggacgtgatattgcacgtgtttttaattgcaataaaaatgtcaatggtggcttggaaggtaacaaatatattgtaacttgggctttaggacatcttgtcactttagccgaccctgaaaaatatgataaacattatcaaaaatgggatattaatgatttaccaataatcccttcaaaaatgcagcttgtagtcattaaacaaacaacaaagcaatacaatgcagttaaaaatctaatgaatcgtaatgatgtcaataacatcgttattgcaactgatgctggaagagaaggtgaattagtagctcgctggatcatcaataaagctcatattaaaaagccaatgcagcgactatggatttcttcagtaactgataaagctattaaagaaggttttaaaaatcttaaaaatgctcatgattatgatgctttatatcatagtgcatatagccgtagcattgctgactggttagtaggcatcaatgctactcgagccttaacttgcaaatataatgctcaattagcctgtggacgtgttcaaactccaaccttggctatgattgctaaaagagaagaagaaatcaggaatttcgttcctcgtaatttttatggcataaaagcagcaactggtaatatcaactggtcctggcactcaaacaaaaatgaaacttatctttataacgaagagaagatcgatcaaataattgataatctttccaaacagcctttaaaaatcaacgaaatcaataaaacaacaaaaaagaaatatgctccccaattatatgatttaaccgaattacaaagagacgctaataaactttatggcttttcagctaaagaaacattatcgatcatgcaagatctctatgaataccataaagttttaacttatccccgaactgattcacgttatttaacagatgatattgttccaactttaaaagagcgtcttgaagctagtcggggtgggtattatgatcacataatcaacaaaattttagctaacccaataaaaaaacaagctcattttgtaaataacagcaaagtaagtgatcatcacgctattattcctacagaacagccagctatgctaggatcatttaccgataaagaattaaaaatttatgaactagttttaaaacgttttttagctgttttacttccaccatatctttatgaacaaacagttattaaagcttctatcaatcaagaaagattcatcgccagagggaaaattgaaaaacagatcggttggaaagaagtttatggtcaaatcgaagatgaagatagcgataatcaatcactaccatcattaaaactaaatcaaactttaactgtaaatgagcttactaaaactactggtcaaacaacaccaccagcatattttaatgaagcaacattattatcagcaatggaaaatccgattcaatttacaaacagttcctcaaaacaaattaatactacattaaaaaacacgggtggtttagggactgttgcaacaagagctgatatcatcgaaaaacttttcaatactttcttaattgaaaaacatggcaatgatattagagtcactggaaaaggcagacaactattacaactagtaccccaagatttaaaagagccagaattaactgctaaatgggaaatggaactagcaaaaatcgctaaaaacaagcagaaatcaaatgtatttattaatgaaatcaaaacatatactcaagatttaattacagaaatcagtgccagcgaagctaagttcaaacatgacaatctaacctctaaaaaatgccctgaatgcggcgaactaatgcttgaagtaaatggtaaaaaaggaaaaatgttagtatgttcaaaccctgattgtaaacatcgtgaaactctttcaattattactaacgctagatgtccaaactgtcataaaaaacttgaactagttggtaaaggtgataagcagctgtttgtttgtaaaacatgcggttatcgtcaacatatgaacgcctttaaaaaagagcgcgaaaacaagcagcagacagcacgcaaaaatgatgtaaaaaaatatctacagcagcaaaaaaagcaacagacaaatattgaagattcaccatttgcagctttattaaaacttaaagatgaattaaaatagttcttatcgtttgataagaactattttattaaagatcatatcttatattttcaaatcaataataaaaaaattaagaatttaatcttaatttttttatgcctgttctaaagatttaataatagtttgtgtaatttcttccatgatttctgggtgtgtgtttaagaaatttttagcattttcacgtccttgaccaatcttgtcacctttatatgcataccatgcaccacttttttcaacaatgtctttttctactgctaaatcaagtacttcgccatcacgtgaaattcctttaccatagataatatctacttgagtagatttaaaaggtggtgctactttattttttactactttgatattagtcttatttccaacaatatctgttccttgtttgattgcttcactacgacgaatttctatcctaactgaagaataaaacttcaaagctctaccacctgttgtcgtctcaggattaccaaacataacaccaattttttctcttaactgattaataaaaattattgtacattcagatttatttaattcggctgcaatttttctcaatgctttagacatcaaacgtgcctgtagtcccatttgtgcatcgcccatttcaccatctaactcaacttgaggaactaatgctgccacagaatctacaacaactaaatcaattgcaccagaacgaaccaatgtttccgcaatttccaagccctgttcaccagaatctggctgtgataaaattaattcatcaatattaacacctaaactttgtgcataaacaggatcgatagcatgttcagcatcaataaacgctgcccgtccaccttgtttttgacattcagctatagcatgaagagttaaagttgttttcccacttgattcaggtccatagatttcgattatgcgtcctttaggatatccaccgattcctagcgccaaatcaagagttaaagatcctgtaggaattacatcaacactaacagcagcacgatcacctagcttcattacagaaccttttccatattttttttcaatttgtttaatagcatcatctaatgcttgtgcttttttagcttcttctttattttcttttgtctttgcctctgccatttacttaccctcctactattatatactttctaaattattaatttactttaattttttcaattaattttctaactacaaaatcaattgcctgttgctgaatttcttcacgcgtaccttttaactttaattcgtaaatattaacaccttcgtataaaataccaatatatactagaccaaccggttttccttccatcgcatctggtccagcattaccagtaaaagacacacatatatcactatccaatatttgcttcccattaatgcacattaaagaagctatctctttacttactacaccatatttttcgattacttcatgagatattcctaataatctttcttttgttttattttgataagttactaaacttcctttataaaccttagaaatgccaggaatacttcctagcattgcagcaaaattacctactgtaaaactttctacactagatatactaatattatattttattaatgctttagctaattcatccatcacattgtctccgtaagcatttcttgatttttaataaaataatcgattccactgattactgatataattgttgctacccatgctaaaattgcagcaatatcaactctcaatgcagaaaaaggaaaattatttactaataaaaaacctaaagcaatcatttgactgactgtttttaattttcctaatttactagctgcaaccactacttgtttactagctgcagacattttaatagcgtcaactatcgtatcacgagatatcatgattattgggataataatgttaattgtaccatcacttgctaacagtaaaaaaattgtattgattaataacttatcagcgattggatcggcaaatttaccaaaagtagtaattaatttattttttctggctatttgtccatcaaaataatcagtgattgaagcaattataaaaatgatcaatataatgatatttgtcagggcgatatctgtttgtaagatatgatagacaggaacattaattcctgccacatcataaggaaacatatatatcaaaattaataacggtactaacagcactcttgtaatcgtcaatttattaggtaaattcattatttcacctgcgttatcttaagggtctcactacccccgttatattcacttggatcaatttctaataattcatcattgatataaaaacgatgtcccatgaaatatccaattcttaaatctaagttttcaaaagtttctgcatcgaattctaattcgatagtgtcaggagttgcatctaacgaattacttttattagcatcattataaattccgctcttgaatccctcatactctgtcccatttacttttaattgacaccatgtacgccccacaaattcagccttaaatttaattttttcttctccatcagctaatttaaaactataatccaattttccattcttagttatttccacactattagctgttgtttgcccatcatctttcttatcatcatttttatcatcttcgttatcttttgtatcattagaatcatctgtatcttgagtaccactttcattatttccctcaacagtcggcgtattattttctttaaaaccattgttatcactaggtgatttacttgcaacgatcgaataccaaacaacgaaaataatcgctacacaaaccaaaacaaccaaagcatatttaaaatatctcatcaaataacgatcttcatagactcttttattgggaactggttttttaggtttaacaccctttaaatccttaaatgtatcacttactttcccagaaatagttacattttttttattttcttcatcagatcgtttttttcttttattttgatttatttgttctaattgtatctcttgagtcaatgcttcaaactcagcatccaactctttttcttccattcctaaatacttggcaatttttctcaaatacatctttaaatataattcatcgcctttatacttatcaaatgcacctgattctatatctttcaagacagctacagaaataaatgttcctttagctaattcctctaacgtaattcctctagcttcacgctctctttttacatgttcgctaatactttccatgagctatcctcctttttctatttaattaaaaaacccataataaacatttaaattatatcataattattattattgacaataacctaatcacatttattttatgaaagatttttaaaatttatacatcatctctttaaatctgttatcccaaatagataataatatttttttattaactttaagttaacaaaaatattatattttattaaaaaaactgaatagatttaaatctattcagcaatatcttaattattatagtaaagattcatacaattttttgatttcctcaatatttgtatctcttggattacctggacagcaggcatcagctaatgctgattcacttaagaaatctagatcctcagcttttacaatttcttttaagtcagctggaattccaacatcaattgataattgtttaactgcatttatagctgcttttctgtattcttcttgagtcataccagttgtatctacacccattgcttcagcaatatctttatatttttctccagtatattctgcgttatattccataactgttggtaaaataatagcattagcaacaccatgaggagtatcatataaagctccaagtgggtgagccattgagtgaactaatcctaaacctacgttagagaatcccataccagcaacatattgtcctaaagccataccttctctaccttctggtgtattatcaactgcacctcttaatgatttagaaataatttcaattgctttgatatggaacatatcgctcatttcccaagcacctttagtaatataaccttcaattgcatgagttaatgcatccataccagtcgctgccgttaaacctttaggcatcgttgacatcatatctggatcaacaaatgcaacaactggaatatcatgtacatctacacataccatttttctattcttttcagcatcagtaataacataatttatagtaacctcagctgcagttccggcagtcgaaggaactgcaaaaattggtgtacaaggatttttagtatctgcaacaccctcaagacttctgacatcctcaaattcagggtttcgatcaataatacctattgctttagcagtatccattgatgatcctccaccaatcgcaataatataatcagcaccagcatcatgtaatgctttcacaccatgttgaacattttcaatagttggatttggtttgatttctgaatacacttcataagccaatcctgcttcatctaataaatctgtcactttttgagttactccaaatttaattaaatctggatctgaacaaactaaagctttttgaaaacctcttgcttttgcttcagtaacaatagcttcgattgctccttttccatgataacttgtttcatttaatacaaatctgttagccatattttataatctcctttgttttatgttgattatattttatcattcatgtgaaattaaaaacaagttacagatgaaagagtttgtaacatttcaaaaaattattatatataactaaatatttatttttaattttccatttatccaaaaaacaagaactaatatcaaacaaactctagcaaaactctcatataagttttaccatttggacgaaatatcattattattattaagtatctttgtcaaaaaaatgctaatctatttttataactcaatattttatttccctattagataaccagcttatttgttaaaaaaactcacttaacaggaacgtatccgctattattcagttgtcaaagtactcatattaaagtatctttttgcctttttactttatagaccattactacactaattttttatcatttacagtattttttaaacaataaataaatgaagttatttctaatatttcagatatttctttagtagtactagcctaacattttttataatacaatagttaaaatcaatgcacttgtttgagatagtagtgaaataatgtctcattttctatttcatcaagtagatctgtaattgataagatttctttttgattataataagatactgttgattatccaattatttagtgaaaaaagtaatccaacatcataaaaaagtatatttttatcttcatcaacaatatcattattgacagaatcattatgagagacggtatctattttataattttgatcattatttaaagatataacatcattttgtaataaaaccataatatgtaaaccaaataaaactattataatcattttaaataataaatcttttttcaaaaattttatcgttttctttttcatataacatttcctactttcttttcaaatgattttgaataaaccttataactatatgtgtcaatattacaaacaaagtagatattaataaatactctatgatcaatcgaaacatacctgtattctcatcaaaatatgcaaatcgagttaacagaaataaactgatttttaataaacattataataccaagtgcagcgatacaataaggaacagtaatgaatgtcatacttgaactattttcaaatttttctttattggtttaataatggtttgactatgcaatcctaaatgaatagccattaagataaaaccccaatttgctaaaaccatgtgtaacaatcttgctagagaaagaggcatgaatctaaaaggaagaatttccgacatggaaatgccacttaataccaatatgatcacatttatcaataaaagaaaatcgatcactatatatatcattttgatgactgaatatttaccatgaaatatagttttataccacttcccattaaaaatatgatgcaaaataaatataatcatacctaatacgatatgaatcaattcacctgtcttttaatatcccatcaaaaagaataataaaataaacatgacaatatctaaaattctctttttcttcataacctcacatctcttttctaaaataactgtttataaatatttctatttcaatatttgaccatctttaaaagcatgtcctacttgctttccgatctttagataagtattatgaactgcatcaaagataataggttttaattttgttggatcgatttcatcattttcatctaatattctctcatcagcactcacattaataatctttcctaataatagatgtgttttttcatcataactttctagctggcattctaatgtcattggcagttcctcaaaaataggagcatcaatggtttcactctttgatatatgccactttgttttttctaatttattaggcaccgtgttggctgaaacgctacccacatagtcacttgctgtcatttcatcttctgtagccatactaactgtaaaagcttttttatttaaaatattctttacagttttatgccctgcacttaaatataaagcaatcgtttcataatcagcaatacttccccaagcagcattcattgcatctgccactccattttcatcatatgaaccaataataaatactggttgtggataaatatatagttttgcaccaaaattttttctcatgtttatgtcctcctaataattgatttttgtatatacttctgttacgacaaaggatcaacgacttcatttccttcaacaatagcagttaatttgagttttgtaaaaacaaccgttgttatgtcaacacctgctatcttcaaatgcaatatgtttataaatgatccttcctactttgatgatatctatttcttcatacgtgttaaaatgaatcttatatgaacaaataaagcttttaaatcagtgcttttctttaaaacataacaatcattgcatcctagatttcttgtatttttttatcatttttacctcccattcatctttctttatatctttattttataaagacaatcaaaaaaagtacaatatcaattgtttattatattataactataatgcataataaaatagacgattgaaaggtatttaaactgtatcaatgagaatgatgaatcaaatctatcaagttgatactaaatcataaatcacttaaagaacctcatatttattaacataaattaatatatatttgttaaatgaacagagataaaatttgaatttcaaaatagacttttaacaacaatttaatggcaaatattttattaaaaagttacaatttttttaacaaacatatagtaattactgccatagccaacaaagtccattaaagaaatattctaaagcatattctccactatgaacgccatcttcctgccataaataatataaattcccatcagcttcattatcagcatatcgaaaagtaccatcatctacttctaacattgcttctatttggctcttaaaagaagaatatgcaaaatcatctgttcctgatgccgcaaaaatgaaaaaatcattttcactatatcctgaatttcttacaatatcagccatatattccccatcagatgtcaaactcccactagaaggcataaaataacgaaaatcttccaagcaatattgaaaagttctccatgttgctactgaacccatcgaaaatccagcaaaagctcgatgatctcttgataagcgaattccttcttcatctatagtttttgcaaaggtactatacgtactttcaactgctggaattaaatcatttattaattctctatgataattttctgttaaacgaagtgctaaactataatcactgctgtcatctgaacttgtattattgtatgtcggacataccacgatcataggctggatttttttatttgccattgcattatctaaaatgtttttaaattcagcaggctgatcaggagttcctagatatgttgtttcgtcactccacccaccatgcatcaagtaaaaaacattatatgctttttcttcagtataaccataaggtaaataaacaactgctcttttatgcaacacttgttcatgtttttcatacgtcattgattcatatgtatcgtattttaattcaacaagtgttccttgatactctgacacctgaaaatattcctcaggtatttgcataagttcttttggaaatattgcttttgtcacagcatcatcattcactctataaccatttgcttcctgtgatttattatcaggactttctgtcatgttagaatgacatcccattaacagtaaactcataataaacaatttcattaaaagtctatattttttcatagttattaactcactttttatttaatgaagacattcattaacgatttttgcaatttcatttacagaaaatatcgtctctatatcaattttcttaatttcatctatagaaatttttccatcaaaatacatatcaataccaagactttcgaatagttttaccatttgccaggcagattcttctacagttccttgataatcaaatacatcagaaaaataacgaacaatgtcttcatgatgatattttgccattgtttctaaaaagcgtgggaataatgtcattaagctttttcgataagtagcttcaaataaaacctcaggaatgaattccagttcataaatgtcatatgcataattttcctctttgccaagacctaaacgtcctgaagttgaaaccgatgccccataaagaataataccgcgggcatcttcatcataaggattctctttaagttttttcgttgctgctaaaacattttttatgacagaaataccaatatcataagaaactggattatgatcaccaatagtcgaagctgataactgcactaatgtcactaatcctgtataagcggtcatctctttatcaagtgacattgaatattttgggacaagaatagcaacatctgccgcaattccataagcagtcccaaaatcaccagttcttgcatcagctgatactgctcccaaaccatattctgacccactagaaggataagtcggtattaaaataagcggtaattttataagtccataaggattctttttcccttttatataatcccataaatcatcagcatgataactgccaaaagcaatcagctttgcacagtccataatattagcaccgcctgcaccaataattagttctatatcattttctttaacaagctggattcctttttcaataacagctaattctcgtgaagcatttgcaagttcaaaaaataaacctcccgcactttctacagctgttttaacatcatcgtaacagccattcttttttacagaacccccaccataaacaaataaagttcttttttgagccgtatacatttttaaatctgttactggatcgttgcgaaataatagttttgtatcatttcttaattgaaaatctttcatacatcttctctccttttactatttataccattgatttacattttcagcccattttctacaaattccaaagccatgaggataattgtctaatacctgtaattcaatgtttttatttaattgatgcaataaatcaacttgagattcaaactgattataaaatggatcttttgttccatatacataatatgttggtagtaaatcaaaatttttgaacgtactttcatttaaatctgtaaaagataaccttccataaaatgaataccccacgattacagcattagctattgaagatacattatctatttcatcaggaacatacttatcatctaatgattttccattgatcttttcaccaaactctaatactgctcttccattggctataccaccagccaagaaccctacaagcgctattttattttcatctattctgtaatccttagcatgataacgaacaattttaatagctcttgcaatatctattccggattctctttctgtatatggttgcacacgataatgaacaacaaatgaaacataacctaatcgtgcaaattcttcagcgactttttttccttcagtattttctgattgaaatataatgcgcctccaggacttataagcataacccctttaacttttgtcccctctggtacttgataaatcgtcatatatggttcacatcaaaataatctcttatattttcggtgtaattcgttacggttggtatatttcctttttcccatagatagtctgtttcttcacgctattgacccgaataataatcatacacgttgatttcatcatctacactttgtttttgtaaacacccaacaagacaactgctcatcaacagactcatcagaatcaacttcatctttttcataaatttctccttgataattgtattttagtaagaaatacctggataactcctagtacttcttactaaataatagttagtgtcaaatcattttttatcaaattctaattcattgagccagcttctaactgtatctgtttgattcgattccatatctcctccgcgaatagctaaaccatcaagtattgttgcatttggctccaattcttgaatcgttgtatatgttccaccatcacccgatccttcatgagtattaaacggaacgatgattttgccactcaaatcatattgatcaaaaaatgaatataatggcattggtaaggtataccaccagattggataaccgacaaaaataacatcataatcatcaagattgatattcatatcttttaattctggtcgttcatcattgtctctttcgttttcagtataatcaaaaagttcatcaccagttggataaggtttgactgtttctattcttctaaaatctccgccaacctcatcagaaatcaattttgcaagtctttgcgtatttcctgtttcagaaaaataaacaactaaagtcctactgctatccagttcaatactgccactcccttctttttggctttcattttgaatattgtcatctataccaacactgctgcctctatgaaaatagaaataataccctactccacatgcaatcactaccacaattacaataatccccatcaatattttctttttcattttttatcatctccttatttattttccaatactgtcaagccatgcttgaatttctcctggtgcctgttccatatcatctcttgacatcgtaaaagcatttgtttcgactattgcacttcgtaatttattttgaattgttgttacggttccagctaatccacttcctccatgcgttgaaaaaggaatcactgtctttccactaaaatcatacaactcaaaaaatgtatacatgatttgcggcatatcactccaccaaattggataaccaacataaatcacatcataatcatcaaaattgctgattgttgttttgatttttggtcttgcatcttcgttttgttcttctcttgcaagcgcaactaattcttcatgattcgttgtatatggtgtctctggttcaatacgatataaatctccaccagtatcttcggctattaacatagcagcatattgtgtatttcctaatacttcaccctctacaacaatggcactattttcttcctctgttgtcatttccttattaggatcatctgtttctggcactgaaaaatagacaattaatgactttttattatgactgccagtagtagatgggttatcttcagttattgtttcttcatttcgcgttttttcttcctttgataaagctgtgtcacgatttgaataaaaataaaaacttgctccagccaatatgacaatgacaaaacttatcattcctatcattactttttttgcatcttcttgatcctcctttttgtgatattgaaatttttattgatttcattacaattatagatgtcgggagttacacacggtcaatgctttttataaattttaaaatattttttgttgactgtgagttacacccatgttttaaaataaatttagggggtgtaatccatgtctaaagaaaaacaattgtacactatgaaacaagtctgccaaaaaactggattatcttatgacactttaaaattttattgtaatgaaggacttgttcctaatgttaaaagagataagaataactatcgaattttcaatgaaaatgatatagcctggatcaatagtttatcatgcttaaaaaactgtgatatgagtattatggagatgaaagaatatcttcaattatgtttaaaaggtgaagcaactattcctgaaagacaagtcatattagaagcaaaattaagagaattagagcataagattcaaaaaataaacgatagtattgactttattcattggaaacaggaattttatgaaaatgttttaaatggtaaggtgcagtactttagcaacttaatacaaaaagaagatgatgactcataatttgttatcatcttttttaacgaaaaagaagaatttttccaaatccttcctttaaactgttacccaagcctgaagaagatgatgtacaaaatgaaataactgtttcattatttgatcaacacctaacaaataagcttcatgttacaaatcattgctaatgcttttttttattttctcttatcaaataaccaactcataatttgttcatctttaacaaacaaagcagctcctccaccatgttgatttgtcattccttgacttgtaaaataattttcatcttttatatctaaaactaacagctcattgatctcatcatcagataatccctcttttttatataaacgataaagttcatcataagtttcttgagaaggctgagagccatagtattcatcatcttttcctatcgcaatgtagacaggcgttctattttcaataactgcttcataatcaccatcccattttgtactggcatgtaaataagccgtaaaaagatcggctctttttgccataacaagtgacatcgtttcacctccaccagaatatccattagcataaacctgactttggtcaatgttataatgctctataaagtattctaccaaagcaattgtttggttagctgaagtttcaccccagtcattcaattgaggagcaacgataatcattttttcattataatcctgggcaacaaaactaaattcttctgttttgatattttaaataaagtccctgacaccctggtaaagtaaaatataaggcatatggttcacttccatcataactatctggtatataaacattataatgaatatcaccattgtcctgtgaatgaagaacattatctaataaaaaaccacgatattcatctgttccggatgtcacagtttcctcattgatcgggactgttgattttttttcattatttgattcactaacagattggctatcattctgtgtattccaaaaatataatcctattaaaattatacatataccagtcaaaagccattttttcacatttcttcacctccttccatatttctaatctctatctttcatctgctttttccaaaactcgatagcatgatcgatccatccttctgcttttgtcccttcacctaatccaaaaccatgaggcaatccatcaaatatttctatttgggcatctgttccatttgcttttattctattgattctactttccatcacttgataatttgctattgtatcagctgttcctacacaagcataagtagcgggttcggttcctgttacttcagataatcctgtatactgcataataactgcatttggttgtgggtattctttttcaccaaaagactttgtaccataacttcctaaccatgctgccattcttcctcctgctgagccaccccatacagaataagatgaaacatctacttttaattcatttttattttcatgaataaaagtcacggctcttgctagatcttccatagctttattggcatctggtcgataaatcaaagcaaaggcattatatccgtttttagatatttccaaggcatgaggaaaactatcttgcatcgctcctacatacataaatcctccgccagcattaacaattgcaaatttagcattttcttctccgcgaaaataaaatattcctgtgtttcttttttcaggatcagtctgcatttcttcttctgtataaatgttataaaatatttgatttccagaatcagtttgctcttttaaataattaactatttcaactgttttatcaggattgatatagttataccaaatatataaatctccagattcttccaaagtcatattttcatctattgttctattaacaggaaaaatcagtctaccaaagtttttaaatgaagaattatttataacatcgtaaacttttgtatcctttgtaaaatattcaatatcattacttacttcattatttttatcatttgactgtgtacaacccattatcatagacaacaccaacattattaaaacagtatcctttattcgtttcatatatcctcacttataaataaattttcatatcactaatgattttatgactttggctagaatcaacaataacacttttgagtttcatactcataatttgagaaactctctttgctaaatatttgatcatattgactatattttcatctggagaagatccttgagcaaataaatataattcttttcctcttaatacttcttttagtaagtaaattctatcaacaaatgtttttaaaattcctcctactgtataccaatatataggtgcaccaataagaataatatctttattccttattatctttaaaacatcacttatttgatcatcatcagacaattgcaaaatatcatgatccacatcttttaataattcctttcctattctaaaagtttttccactttcattaggactataattcataaatactgttcttttcatttgtcatatcccacctttcactaaaaccttacacccgtgtgttacacccatgtcaataaaaatttttttatttctcttaacagtatagacttttccattttcataattttttaaccttctcatgccatccaaatttaaatattgatttatctgctttctgaagtgcaccacagaccgaaaaactaaaattctgcatttttcatatcactttgttttttatacaataaaaaatggcgactatatcgccactttcataatataacataaaaaatttacagctagattgaaccaagaaacaaaagataaaattcctatcgatcgccaagaaaattaaacataagtaaatctagttattatgattatttaaaaagaattctgtataaaattcagtgtcattttgctatctgatacttatcttctcaccaatctttacctccctgtttatatcagaaacgttgatttcttcattatcagtaaacaatatcattgttaaagtagactttcctaattcatgaactttttgcaaattaacattaacaagaacatcgccttgtttaactatatccccttgtttaacagcaacatcgaatccttccccatttaatgcaacagtatcaattccaatgtgaatcaatacttcaccatttgctccttgaattccaaaagcatgaccacttggaaaaactgtttctaaccgtcctgaaataggtgcaataattttcccatctactatgtcaatagcaaatccatcgcctaacatttttttagaaaatgtttcatctggtacattttctaatgcaatgattttaccattagctggagaaataaaatctttatccaatagttcattgacatcctctccatcaatagcttcatgaggtacaccaaatatatatgtgacaataaaacaaaatccaattacaaatattgacactaatagatatacaataaattgatagctttcatagatatacatcaaataagaaggtataactgctaatccatatgaattcgattgaatatggaaaattgatagtaatgctgctcctaatcctgaagatgcgcacataataattaacggttttaaattataacgcagctgaattccaaataaaacgggctcgcttataccaaataactgtgatagcattgcaccgattgcagtctgtttaattttattgtttttagatttttttataaaggctaaacaagttcccacatttgcaaaaccatacattgcacaaagagtaataagagcattaaatccagtatttgcaagtaaagatgtttcaatcatcacataagtgtgatgtaaacctgtaataacggctaatggatatgtgaatccaataataaatccaccaatacctaaaggtaaaccaattaataaaccaataatatctaccatttttaattcaattgtatgcatgataggtcctacgcctaataaaataactaacatagttatcagcataacaaagaatggtgtaaaaataagatccaaaacattaggcatatgtttacggaaccatttttctagattagcaccaatcaatcctgttacaatcgctgttaaaacacttccttgacatcctacaataggaattacaccaaacgccataatagcttccacttcacttgctggatcagcaactgaatatgcattaggaagtattggagatactaacatcaacccaataacaagtccaatgactggcgttcctccaaatactttaaaggcagaccatacaataatggcaggcaaaaaggcaaatgctgtttctgtcaacactgaaacaagtgtttgaatatatactggaatattgctagaagacataccaaataatcccagaacattatcattaaataaacaactttttaaccctaaaaataatcctgtcgcagcaattacaggaataataggaacgaaaatatctgcaagtgttctcattactttcttaactcctgtttcattatttttaattgcttcatcttgttctttttttgatagtgtttttaaccccattttttcaacttcgctataaactttattgacgattcctgttcctaaaataatttgatattgtcctgaagtaaagaaaacacctttaacttcagcaactttttccattttcttatcattaattacttctctatctttaaccattactcttaatcttgttgcacaatgtgtaacagataaaatattatctttaccaataatttcaataatatcatttgctattttacaatatttatccatttttctccctcactttcaataacacagcatgaaatggttttaaactcattgtttcatttaataaatctatatcatctaaattttgaaatacaacgtcatatttttcttttatttttattgttataggttgattagaaaaactataataacaatcaataattattttatctaatcgtcttctataagctatgatcttatcattatctacttcaatgggttcaatagatccataaatcaaacaatcagaatacttacttttttgtctaaattttatcatctttttataaaactctaagacactttcggaatcattgatttgactttgagcattaatttcttgataattttctgtcaatttcaaccatggttttgaatctgaaaagccagcattttctttatcattccatggaaatggcgttctagcattatcacgacttcttaagtttacaaattccaatgcctgttcttttgaaaaaccttcttctattgaacgataatattggtctatactagataaatcattaaaatcttccatcttatctcttttaaaatttgtcattcctaattcctgtccttgataaataaaaggtgtccctcttaaaaagaaatacattgtccctaacattttaaccgcatcaatatttctttcatcttgtaaaagatattttgttgtagctcttggctgatcatgattttcaataaaattagctgcccagccatacttttgtacattcatttgactatctaaaattttttttctcaaatctctgattgtccaaggaattcttttaaaccactcactaccagaagcgatatctaaatcagcatgtttaaaatcaaaaaccattgaaaagaacccatcttcgccaataaattcatcaagctggtcatagttaatacctgctgcttcagcaactgtcatacaatcatattttttaaacgtattttcttttaattcataaagcatttcttcaattcccggttgatttctcactgtttttgtacactttacaagtccatcaacaccatcgctttctaaactttgaaaacttaaatctttttttataaatgttattgcatccacacgaaaaccagcaatccccatttgcaaccacgtattgatcattttataaagttcatttcttaatataggattttcccaattaagatcgggttgtttttttccaaaagaatgaaaatagtattcgtttctattttctactttttcccatacactgccaccaaatacagatcgccaattattcggtagatcttccccttctttaaaaatataataatcatggtacgggctcagaggatttttcaaagcttctttaaaccagggatgttcatcacttgtatgatttagaaccagatctaatataattttgattcctctcattttgctttctttgatgagcatttttagatcttccatattgccaaattcatctgcaatatctaagtaatcactaatatcatatccattatcatccatcggtgatttaaaaattggacataaccacaatgacgtaatacctaaatcttttaaataatccaaccgagaaataatcccttgtaaatcaccaattccatcattattactatcttgaaaacttcttggataaatttgataaactatttctttttgccaccatttcttttccataaatgactccttctaaataatatttcttctttttaattctttataaatgccatcatcaaagatgtcttcacatattgatgttgccatttctttaagctgctgatgactattcttcattgcaacagcaatatctgatccctgaaacattgttatatcattttgaccatcaccaaaacatattgtttctttttttgtaattcctaattttttctgtaatcgttgaattgcttttcctttattaaaacctttttgaatgatttcataatattgagtatgtacatccatttgcgctaattccattttatcttttaatatatcacttacttcacaaaaaacttctttatttgaccataaacagatcttatgtatatcttgtgatttatactctttgatattattttcatatattattttttcatgaataaattgtttatttatacaagaataaagtccttttaattgattcatcgtttcaaaaatatctttagcttttttattcataaaaacttctctttgactttctatcgaaaaagctacatctctttttcttaataaatgaacaacttcatgcattaactcttgattaaaagattgattataaaataactcatcatgatattgaacataattgcctcctccagcgatatatccatcaacccccaataatagaacatcatcttgaatcgtacccatacttcttccagtgcaaataacaacattgcaatgattcttttgacataaacgtatggcttgtttggcagattctggaattccatgtttttcatctctaagcgtaccatctatatcaagtactaataatttgtacaatttcatcttcctttcttgctagcaaaatcatcatatcatcccaaaaaaaggacatcaatattttgacatcctttaaaaaatatgttcatttttagtacaaattttcattttatgggaatatgttcactttctaaatacatcttatatttaatataaagcagctcaattaaaataaaatatggtgttgtcacatcatattccaactctttatctacagaaatagataaagattgaatatataaattttcatcacataactgcgctaaagaattgcttatcatttttgtaatagaaatcatataaatgcctttcattttcatttgcttagcaaaatcaataatattagacatctctccatttaatgaaatgaaaaaaacaagatcatttgtttcaataaaatgattgagcgaaggaatcatatcataaccataaacatcatatataatttttcctgttggtaaaaaaatcctcttcatttctttggctactcttccctggccatatccttctccaaaaataatgatccgatcagctttcttcattctttcaaacatgattgtgcaatctttcttttcaatatcgtctataactttattataacaattgagcaactgatttttacttatactcttatattcagtttcttcatcattcaaacgaacaataacccttaattcactatatcctggtaaatgtaatttttgagcaaagcgggagagcgtgcttgtagatatatgatatttatcagcaaattcatctatagaaagtttaatacaatcttctttatgattaagaatacatttacaaatatattgatcatttattgtaaataaatggtaatatttattcaaaagttcttcaattttcatatttatctcctttatattcaagataattaatatagagcatatctaataacgcataaaatgctcctacaacctcataagaagttgcttgtaatgtattcagtttttgcgttgctacatacaaattatattcacaaagtgttgcaatggtattattatcgagtcttgttaaagaaagttttgatatataatcgttgacaaattttgcaatttcaactccttctgcagtttcacctgataaagaaatgatgataaataaatcttttttttgaaatgttttcctcatcaattctacttcacctatatcaaataaatcaataacacatttatccactgaaagaaatattctttttatttcctgagctaaacttttttgttcattacccgttccataaatatagatcgttggtgcctcatatataatttgacaaatatcatgaaatggtattttttgtaactcattgatcaacaaccgataattctcacaaatattatgaaaactattatcagtttcaacaaattttagctgattatttttaagtaaatactttagatcagaaaaagaatttaatccaatttttctacagattctcaatagagttgctctagaaatatggcactcgtttgctatcttttgacatgaataatgacgatattcttgttgaaaaattaaaatttgtttcataacaattttatcattttcattcaaattatcataattttgattaactaatgcttctaatttcattttctttactccctgaatgttattaaactctattttaatatatatcaaatatttttactagtagataattatcaaaaatataaagcacatttcatcataatattaatcatccagatatcaaaattaaaatctttctatcccgctaatcgaatcaatattagctaaaaattcagatgttttcttaataaattgattttcagataaaaaatacagaagtactattaaacgatttctatatactaaaaataacagacatattcatcgttaataaatttcaaacaatcaataaaacaacaaaagatgaagataaattattagttcttcatcttttcaaaatttctaaaaattaataatctctatataatgattacatcttaattcatatcttttaccaatttttatagttgatatctcataatatggatttatttcaaccaaaaacaacagagataattttaattaaattaccaaatattatcattttattcttttaaaactatcttataaaatgagtatgcacacttttttctttttcaggaagtccatatttttctttccctagttgaatactttttattaaaaacgccatatttttccctagcacccgcatcgtttgcagtccttctgcatcttttcttacatcctcagcagtatatccatgaacactattccaatattgactagaaacaaccggcatggaagaaattgtaaaatatttgtttaattcatcaaatgtcgctgaacaaccgccacgtcttgctgaaactacagctgcgccaactttcattgttttatcacactgactactataaaacaaacgatcaataaaagaaacaagggttccattagcagaggcgaaataaacaggtgaccctatcacgataccgtcacattctataaattttgctgctacatcattaacacaatcatcaaaaatacactttcctatttttttgcattgacgacatccgatacagccacgaatatctttatgtcctatctgaataatttctgtatcaatactttcagcatttaaaattttttcaacttcttgaagtgctgtatatgtacaccctcttgcatttggacttccatttattaaaataactttcattattctttgctccttctatcctttatttttttaagtattatatatcctattcctatacataaaaaactaataaaaagatactctttaataaaatcaaaaatattcatttcataatcaaaaaacacaaaactttctattgaaaacatatacatatagattctattttttataaaaaactaactgtatattataagatagctttttaaatttcttttttattggtatgagaatcacatgccaatggaatcctaaatgaatagacatcataacaaatccccagtatgaagcaaccatatgaattcttctagccaatgaaatcaatccaaatgaggaaataaagcgaaaaacataattagacatcaacattccacttatccctaaacacattatatctataaaaagaagaacatttactaaagtcattaattttctcgacatttgataacgcccttttaggataccttgatgccacttccaattcaatatatgatgaacaataaaacaaagaagagtaattgttcctagcaattcatgtaattgttgacctgtcaaatgaaaagccatcaataacaatactaaaacaaacatcataacatccaagcttctcatcaatatccgtttcatctatatcaccacctataactactcttttaatgagtagtttctttatttattttatttgaagctcatctaaccattctttaacttcatcatcacaagatactacatcatttcttgaaatcgataagccatttgatacaactgttgcattagactgtaaatcagcaattacaccaatcgttcctgaaaagctactaccaccatgcgtagtaaaaggaataattgttttatcagtaaaatcatattgttctaaaaaagtatataatggcattggtaaatcagcattccagttaggatagccaatgaaaactgtatcgtactcatcaaaattatcaatttcattttttaattccggtcttgcatttttactacgttcttcataagcaaattccaataatggatcatgtgtttggggatagctttgaactgtttcgattctatacaaatcaccaccgctttcctgttgaataagactggcaacatattgagtattgccaacaacaccattttcagttgcaacacgactagctgaagaaacagtatcttccccatctgtttcaggtactgaaaaataagttatcaaaattctatttgctgaaatagatttattatcagaatcttgactcgcttgttttgttgtatctactgtatttgatctttcattattttgaaagcatccaaccagtgatcctgctaatactattactaataataacctagtgatctttttcattttattcctcctcgtataatatattttgaccatattcataagctgtttttaagcttggtgtccatcaatatctcccatttgccaagtgtacacgtcaattgatttttgctcctgatacacaattcattaaaccatacatggtatgttgatttcttatcatcaacagctgtcataataaaactctttatcttttagctgttgaggataagaagttactaagatcctgttttaattaaacattgatgaatagaaagataaaacgaatacatccactttattcatttcttttaagaacattgtcatctcattttcctagatacaatgatttacttttttacaaatataacaggctttacaaaaatggatatttaaatcttaaagataaattttttcacttcgtgtccagcttcctgaccacttttttgaaattgtttgcacaatccgtctgaatttccatttttctagaacttgctgattaaaattaacatgtttttattcatatctgcctcctctattctaacactctatccaaccagttagatatttcatcataatcactgattcttaatccctctttcatatctgcatgatcttgaagatcatcaaatacatctaaactttcttctataccatcactgctgcttgtacaaaacggaataacagttttaccagtaaaatcaaactgatgaacaaatgtattgatcattgctggggctttttgccaccagataggataaccaataaaaataacatcatattgatcaatactatcaatagacaaagtgatttcaggctgctcaccattgatgatttcattttcagctatatcataaaaatcatttggatatgcttcttttctggtaatttctaccaattgtccatcagtttgtttttgtatttcttgagccgctttttcggtattgccactatacgaaaaataagcaataagaatattttgatctgtaactgttaccgtttgttttggattctctgaggtttgatcttgttcattttggtttgtttgactacatcccgctagagtcagcgtgacaaacacagctaataaaaacgataatacttttttcatcttcaattcctcctaaaaattcatttattgattcaacaaaagtcatcttgtatattccaatgatgatctaagattatttcaataatgaccgaattacactactaagataaacccattcgataattaccgatcatttttcaatattaatagttatcttcaacatatatattttcaactaaataattttctatatagctcattgcttctttaaaattataatcataaaacccatgaccagctccttcaatcacttttaattgagcagataaataaatattctctgctttttttgaataagatagcggtacaatattgtcagcgtcgccatgaataatgagaacatcattgttataagaagatatttcatcataaacatcataattcaacaatttttcaaaataaccttttcctacactcatccatagatgataataattatctggaatatcatcgatactcttgaacaaagcttgcgcctgatccactaacacaaaagctggatacagaagcatcattcctctaataatttctggatttttagctgctgttatggcagatacaacaccaccctgactagaacccaacaaaaaaatattatctttatccacaaaatcaagttcttgaatcattttaataacagcttccaaatctttctgttctgtaaatattgacatttccaatgttgattcatcactcctgcttaatgggctaccaccacaaaaatcaaaacaataagctccatagcctaattttacaagttccttagcatactgaacaccatcttcatgataaccgccaagaccatgacaataaataattattggcactttcttatcaatatatcgaggcatatacaattcaccatatatttgttgactatccctacttacatataattcctgcataacatatgattgatctgtaagaatggtcattttgttattcttcttttcatctactaattcattattttgaacattacatcccaaaaatgaacatactaataaaacaaatagaactcttagatatttctttccctttgttttatcatcactataagcattctttaaggatttcaaagatttcatctctttcaaatttctttacacatccagctgttaaattgcaggtatctgcaacatttctcaaaatattctcatctgtgatcttcatctcagttaatgtagttggtagtcccatatctttaataaatgatgccatcgcttcaatacctgctaatgctatatcttcaactgttttatcaactgaatcaacatgccaaacttctttagctaatcttacaaattgatttaatccttctttgtacatgtggcggtataataccggatgaataaccgcaagtccctgtccatgattacaatctgtataagctcctaactgatgttctatttgatgtgcctgaaaatcagtaaccttaccaatttttaaaataccattttctgccatagcagaagcccacatcaattcacttcttgcgtccatatcataggcatcaattaatagtttcttcatattttcaatgacaactctcatgatagattcattgatttgatcagataaattaggaattctaggagttcctaaatacgtctccatacaatgacttaatgtatcgaatgcccctgagatgacctgtttcattggtaatgatttggtataccaaggatctaatattgcaaaacctgcttgtgttccaacaattggtcccttccacattttttcttcatgtgtaatgactgctccagcattcatctcggcgccagttccactcgctgtaacaattgctcccattaagataccatcagttggaaattgtccgtctacatattccatattccaaatatctttttctaattttgcctgtgccgaaataattttacagcaatcaatcacagagcctccaccaactgctaaaataaaatcaacttttttatctttagcaagtttagctccttcctgtactttcttatatgtaggattgggcatgatacctgaaaaatctacaacttcttttcctgcattttctaagatttcttttatttcatcataaattccattcttttttattgatccgccaccataagcaagcataactgtttttcctacttttgataactcagttggcaaattttccttagctgcatttttgccaaagtatgtctttgtttttaattcataattaaatgtattcatcgttctagcctccaatatttatcttctttaaccattcatctatttctttttcatttgcctgttccattcttaagccttcaagcacatgagaatgagggcatattttttgtattgattgaacactttcatcaattgatgaacttgtacttgtacaaaatggaatgatcgttttttcacttaaatcatagttttccaaaaatgcatcaactgccatgggttctttgtaccaccaaataggatatcctaaataaataacatcataatcatctaaattttctggcacatttaataaacttggtttaatatttaaatatttctctaaccaggctcttagagaggtagcaagaaatggggttctataactttttgaaacttgaattgaggataaatcagcacctgtcttttcttgaatcatcttagccgctatttctgtattaccttcgatgtgattattttttaaatttaaacttgcatgggtgctaacgtcaatctcatcatcatactctaaagcatttgatcttgaaaaatagataatgatcgatcttgaatccttctcacctttaacaatgttttgtgtttcatgattcaaagaacttcctgtcatacaataaataacgatgccaacaattgccaaaataacaatacctaatataactaatatcattttccttcctcttttatacttcatcatactatccccattattttaattttgaagctacttcatcaataacagccatcgcatttaatgatcgaggatagccaatatagggcatacattgttcaacaatctgatacagtttttctttatcatttcctacaccaaagtttcccgcagtatgtcctcttaactgattttcacaaccaccctgtgctaaaataaaacaaaaggttatcatttctctttcctggtcattaagtccatttctcgtatagtaatctccaaaacaattagaagctaaccaacgattgatattttgtcttggtcccgtatctttttgtctatcagccatttgcaaaccaaataattctacttgttttgcaagccctttttcaaatcttgattctctatttgttatactttgagctggtaatggtaaagaaattccatattctttcataatttcgttcgtctttaataaataatcagatactctcccaatacctaaataagcggctgcttgataaacagtttctttaatagcaacaggatcaatatttgaatctaatgctacatgaagcatatgacaatattcttccattccttgacagcctaataagaccgataaaatgcatagcattctctctttctctgataaattaccaacatttaggacttcttcttgtaaaaagtttttaataatatctacaaattctggatcagtagccataaatttactattaatcttattaaataattgtgttttttgtttttccatatttacctccttaatttcctttctttactacaatgcaattgtatcaaccggttgtaagaaccggtcaagagctattttaaatttttttaaatttcatttacacaatgaaataaatcaacacaactataaaaaacttatatagtttgatttataaaaaaatattgatcataaaaatcagcaacaagatctttacaaaagttttacatagttaaatcagacactaaaattatctttaatgtaacaaaagatgaagattaattataaattcttcatcttttaaattaaaatatgctatttatgtagatgtatatactgttgttaaccacccatcaataaaataagtaatctcctcagtttcagaaatttcatcaccattaaaacctaaaccaggtaaaatatctgctccttgtatatatgattgaatcgtactttcaaataaatcatgatccattcctcctacccaataaggggctacatctaatccagagaaatcatattgctccaaaaaatttatcattgattcactaggttgattatctattacttcatttcctaataatatcaaatcataattttctatttgatagttttcagtacaactaatttcacaaatatcacatactattttttcttgtatcatggaattaaaagtctcaagaaaaccacaagcgccatcatgcaaaatcaaaatatttctttcattttcaaatatgatattagattctgctttggatattttttgagtattcaagacacaagctgactcgtactgttctttattttcaaaagaagtcacatcatattttaataatataaatccttgaataataactgtagtaaaaacaactaacctaaataccatatctctttttagaaatttctttttcatcaacgtttcctcatactaaataacatctagaaaattactgactaacttcattgatccattcgctgatttcttctcgatcattttgaacactgctgccacttgttgtatatccatctaaaaccgtagcatttggacacaagtcctctatctcacttattgcatcagaaaatcctgaaccacctgatgtattaaaaggaattattattttacctgaaaaatcatattcttctaaaaatgtataaagaggcattggcatcccataccaccagttaggaaaacctaaatagataacatcataactatcaaaatcttcaacatgtgatgctaaagctggacgtgcgtttttatttctttcaccttgctgttgatcaactaactcatcataatcagctgaatattttgtttgtgtctcaataagaaatttatctccacctgtctgttcaacaataacattagcgatatattcggtacttccaataagtgtatcaccatctacgatcacacttgctgatgaagaagtatcaacatcactaggaaaatcagtattacctactcttgaaaaataggcaacaagaattttttgatctttttctgtttggttacttgtaatttcttcagtttgctttgtatcatcctgtgatgatgaagcatcttcattttgggtattttgacatccgaccaacatcaataccataagaatcattaaaatctttttcattatttatcctcctattttgtattaaatgttatatcttcttttgaagagagttcatgaaatatttttaaatctgatgttacttttcctacaacatagacttccatcgttaaattaggattatctgattgattatagaaaatagcaagtgagttatttgtgggacaataagtaatgtcaccattttcaaaagaaagttgtccactaccttgtacttcgattgtttcatcaatcgtgccataaaattctctattgccataatgaaccattgaaacagtaagtggtaacatcgtttttaattgttgtgccatttgactatcatttaattgtccatctaattgataatcacaaatttgtatacttaattgactattatcattgatatttaaaccaagaccatcaagccattgttctatttgactttcagattcaaggatttcttgagaatcaattgcaattccttctaacatatttttgctttttgaatattcctgaatttcgtcataactgtttccacttccatatccattatggctgcaaaatggaatcactgttttttcacttagatcatatttttccataaacgagcgaattacttgcgggattcctgtcgcccatacaggataacctataaagataatatcgtattcttcaatttgtatatcctgtccacttatttgaggtaaggtatcttgattttgttcacgatgattttgatcaataacttcttgaaaatcatcagaatatttttcatctacctcaatcaagtatttatcgccaccagttttttcttgaatcaaattagcaacatattctgttgtccctagacgttgatttttatcaatgacaatgcttgctgaagttgaagcatctgtattttcattataatcagcattcccatataaactaaaataagctataagtatttttgtctcattttctgtcgcatcgatctgatgattatctaacgtgtcttcttgaacttgacaggctgttatggtaaacacaaaacaaacagctaaaataatttttataatcttttgtgtcatattttctccttttgccataatttttccttttcataaatcatataatctatatcatctagtttcttttgatacgaatgtaattgttcaaggatcgaaactcgaactttttttaaagtgtctgtttgcgtatctttattggtgtaatatttcaccagtccttgatcatccaaacccaattccattaaattaaccatttctattatttgacgaacatcatcgtcatcaaactccatctgcccattaatagtagatacattatccaatagtcctaattttttaaatttaaatatatcctcctgtaaaatgtaataacatcttgttaaatcttgaatattcattacaaataagtaaccccctttctttatctaattttattttaaatgctaatattaattatgtctaatacttagaataaatgtatttaatgctttttaagcataaaattttaactcattattgaaataaacaaaaaaggaagcattgagatcattgcattaatcaataaaatcaattcttccatattctttctaactctaaaacaagaacatctttttatcttatatattcttcaaaaccatttgaatagctgatttgattattttcatcaataaaacaaccataaacatcatccattgaatttaatagttctatccctttttcttttcctaatgaaaaacatacagtacttaaagtatctgcttgtaatgatgttttagatatgatcgttactgatgataatccattttcatagttataaccagtttggggatttaagatatgatgatatttttgaccattcaattcaaaatatctttgatatacgccactagtaacaacagataaatcatctatcgttaaagttaaaatagattgatctatttcttgcggatctgtcaatccaaccataaactgctcattgtttttatttcccacacacaatacattgcctcctaaattaataatggcattattgacattttcttttaataaataatccttgatcttatcagcaatatatccttttgcaattgctcctaaatcaatcatagtattttcattgagatatgtaatcttatttggggtcaatataatattttgataagaaacattttgcaagttttcttgaatcatatcttgttgagggagttcaggcagctcctttttaaaatcccataatgctgaaatagacccaatcgttatatcaaattgtccttttgatagttcactatattttaaaccctctttgattaccgcatataaatcatctgaaatcatctgttcttgtaatttattaatgctatgattgattttatataattcactcttttcatttgttgatgaaaaaactaactctagatcattgcaaatatcaaagcagtgatttaaaatatcagtagagtttgaatcgtataaagtgatttcaacgattgtatctaaacaaaaccgtttatctgataggggtgtagactgactctgacagccacaaagagtaagaagtaataaaatagtgattaactttttcatagtatgcctcctatttcttattataacatggagtataaaaatgaaaaataaaacctttaaatatgatattattgtcatttctttcatctttattataattatgggcttttttttattaaccagatctgataatggtcatttggttaaaatcacagttaacaaagaagattatggtatttatgacttaaatgaagatcaaacaatcaatatcaatgatggaaatattttaattattaaaaataatgaaatatatatggataaggcaacgtgtcctgataaaacttgtatacaacagggacatatttctaaatcaggtgccagtattatctgtttaccacatcagttaatcgttgaaatcattgatggcaaggatggtgatcaagatgtcaaagtctattaatgtaaaaaggatgtgttatttagccttattctgtgctattgcaattattttaagttatatcgaaacattgattccttttcatcttagtattccgggaacaaaaattggtcttgcaaatattaccactataattatgttattctgttttggttataaagaagctttttttgttatgctgcttaggatatttattgttggtataacttttactaatctttatatgatgttatatagtttagctggtgggatattatctttagctatgatgtcattattttatcaaacaaaattattttcaaattataccatttctattatcgggggcgtttttcataatataggtcaattattaatagcaatgtttttctttaacacatcaacatttttatattatttaccttatttattattgattggaactataacaggtacagtaatcggtataatctcgcaaattatttatataaaaacagaaaattatatcataaaacaaaaataacaatgttttctcctaaaaagattacattgttattttttatttaaactatctattctctttgatttcttttgctaaaaaatcaataaatttagatactgtaaagctaaatgattgatattttttccagacaatgagcgatgttgttatgagttctggataaaaaggtctaaaacataattcctgattagccgcataattaattgagccttctacaacaacagcatgccctatgttatttgaaactaaaatagatgccgtcgttgttaattctgatatagctgcaaaatgaagctgatcatagctgctgcccatccattttttaaattcattttgggtttcacttcttgaagtattaataagcgaaatgccttttagatcttcaggcatgatatattctttttgcgccaaaaaggaatttttctttgtgagaattccatatctttcaaccttatttatttttaaaaaattaagtttttctaaattaactggttctaaaacaaaacctatatcaacaagccccttatcgatattttcaataataaaatcgctattaccatttcgcacatgaaaagtcacttcaggataaatattcttaaatttttgaatatattgccccattgtttttgttgcttcggtaattccacaagctaaaacgatttcacctgaaacctcattatcttgatgactaatttctaattcggttttttcagatagactaactatttcttcagcacgtctttttaaaagcatccctgcttcggttaatatgattttcctctttcccctaacaaataaagcagcacctaattcatcttctaactgcatcagctgcctgcttaacgttggttgtgtaatatgcagaatttcagcagctttggtgatatttccttctcgagctactgctaagaaatattttaaaacccgtatttccatcatgatcacccctcatttctattattctatcattcaaaagaatgttaagcaacggaaaaaaagattggaaaatatatcttattttcaatctttttatacagttatcgatatgctttttcaaatattattctacaattttcatgattcaattcgattggatcagcacaaaacaaaccacccatcgtctctctcgcgttttttgcaagagtgtccatttcatcatatactataccataatcactcattttaagatgatcaacctcacaagttttctgtaattcaactaataaatcaacaaagtcttgtggatcatctgcatcttttttccccaacgcttttgctagatcaataaatctttgatcacaggcatgctggtttacaaaatattgataatattccttactgatcatgatcaatcccgccccatgaggtaaattatgatgataagcactcatggcgtgctccatggcatgttcacttgtacaacagcttaattccataacgatacctgacaatgtatttgcaaaagccacatgacttctggcttctagatcatttccattttgataagctcgtggtaaatacttggcaatattttctactgctttcagggcatacatatcactcatttcattagccattttagaaatataacattccacactgtgaaataatgcatcaaaaccctggtatgctgtatattgtggtggtacagttaccatcaattcaggatcaacgactgcaatgacaggaaatagtgattcatccccaccaaatcctattttttcattagtttctaaattagagataacgccccattgatcgacttcagagcctgtacccgctgtcgtcgtaatagcaacgattggtagtgctgcattagtaagggggttcccttttccagttccaccattgatataatcccataatgttccatcatttgtcatcatcgcagaaatagccttagaagcatctaaaacacttccaccacctaaagcaacaacaaaatcacatttattatcttttcccattgaagctccgttcataactgttgtatgaaggggattggcttcaatttgatcaaaaataatataatcaacatgtgccaattttaactgttctaaagttctttctaaatatccattgtctcttgttgattttccgttagagataacaaccaacgcttttttaccaggcatttgttgttgatgtaattcatttaattttcctgccccaaataaaatacgggtaggaatatgcatttgaaaactcattaaaatcactcctcatataaatttaaatcatttaaccattttgttaattgtccttgtgaaaacccattaaggaccgttgtttgataccaattaacatcattcgaacaactaacttgcaaatatttatctgtttcacctgcaccacttccgccagaagttgcaaaaggaacaattgttttatctttaaaatcataactttctaaaaaagtattaataattgttggtgcaagataccaccaaattggaaagcctataaagatcacatcatattgttccatattttcaatatctttgatgattgcaggtcttgatgttttgtttttcatttcaagactacttcgtgagttagggtcattccaattcaaatcaacagaactatacggaacctctggcttgatttcataaagatctcctaataatatctctgcaattgattgcccaactttttttgttacaccactacatgaaaaataagcaactaaagttttcattctttcctccatttctgtctacatcacatagacacaacactttattcaaattttatttcatagtatttctataaaaaggatatatactacaaagtacttaaaaagaaatagaaataatataagcttttcacttaaaatcattttatcagttcttaataataattcatcatccaataaatctttcaattgattagtaccaatactattgaaactgataaaaagtaaatattactcgaatcgactattacaattaaaactagataattttttaattgactcaaaaatagcacttacttttcttctcttttgacatctatattatattatgataaacgatcaatatctaatacctatattaaattattacaatgcttttaaagcatataaattatattttattacctagtttttatttacaataataaaaggcgaatcatcgccttttaattatattttataacaataattattttgtaatttggaatgttcttgttattggtgcagctagataattaccacctaaagttacaacagtaacaacatatcttcctggttcagttggaggtgtagtcgtacttgaataaagacggaatttacttgtcacaccagtatataaataatgaatgttactttgatcttttaacgcttctccattataagtaagtgttgcattaaaatcaaagtttgctgcctgatcgactgtcatcttaccattttcaattgtttcattccacatcaatttgataccagaagcacgcattttaacaagcagcattccaactccaacaccagtttcatagtttttattgtcagttactaccgttgttaaatataaacctgctttatttggggttccaaaggctacattaactgaatcaacaagtgaaggtaatttattgattacttctaaaacctgtccaaatacccctgtatcaatattcaatttatccaataaatctaataattcttgggtacttaataattggcgtaattcgcctactgtaattccatcattcataatttcagtaaatgtcttaccataaattttttcaacgattggatctaagatctttaatactgttgtatctgtataacgagctggtaaatttaaatagatagcagtcgttacattacttgttataccagcataaatttgatattgatcaaatttatcaactggatttgttgttataaagtcttcaggaagtgcttcatcagcataaatattcgttgaatgaacagtaactttaactgtagctttattaactgaaactgtagtttccacagtttcagatggacgataatcgccatttccattatatgaaattctaatcttttgttcaccagcacccatttgtggataagttaaaagatttacttttcccccttcgattggtgcccattgtttcactccaccattaacattatctgttaaaacattttcaccataatattcaattgcaaaatcatctatatctaaagtatctgattctggtaagattgattgctgccaatcgatcacattatttaaaatatcttgtttcattacctggctatctacattatatgtaaaagaaccaccatctttacatactattttactagcaagtctattatctgttacggttacttctacaacaacagatccagctttataatctaaattgccattccatgataatcgtatttgccatgttccagcaccaaatttctttaaatttaacacatctttattatctaaaggctgataattatcacctaatcctgtagcacttgcattatattcaactttaatatcactttcatttaattcaggatcagttgaagcaataacagtattaatgatagctttttctattcctgaataatcataactttgatcatcattaaataccatatcaatttcatatggaccctcttttaaattccactgcatttcattacgatcaataaagtttacactaacttctgcactaacagaaccatattcatcatttcccgcaaatgaaactttaataagctgttctccctcagtaattcctggatagcttataagatttaccttacctcccgcaagatcaacccatgctttacctaaacttcctatagctcctgttgtagcagttgcgtaataactaattgttacatcatctaaagttaaagctggagttgttgaatcaacgatagtattaaaaacagcttcttttaatgcttcataatcaacagttaaatcttcgttatatgcaagtttaacggaacaatcatttttcaagataatttgtgaatccaaattcatctttttagttaatatcacttcatcttctgttccagctaaacggattcgataatcaccatcactattatttgccaatgatggatgtgtatatgttgttgttacaaaagctactttcttttgagaagtaaatccttcgatcaatccccatgcatcatttgttaataatccatttttcccagtacaataatattcccactgtaagctttgaacatcgatttcttcaaaattactaactaatgcctttgctaaaatttctttaatagttgataaatcatcatcttcatgaataatagctgttccgtttttcaattgtggtgtaacattttcttgttcgttaataatggtttggttttccaatgcaaatgttgcattcgtcattccagaatattgaataacaagaacagcaataagtaagcataataatactttcttcatatttttctccttcctctttttattaaaatcatctatctacattatatacttcaatttaaaaaaaatatatattttttaaacacagacaataaataagcttgattttatcatcaaaatcaagccttttattcatttatttaatttcttataattttaatagcattcctataaacatcatatcttaaaccatgatagatcaagatataaaaatcttcatttaaatccataagtgtatcttggggttctttgatctctaatcgttcaccaatatcatatatcttattaccaattttaacagcttttaaaaattctatctccataataagctctctccttttacgtgaaaatattaaattcataaagcattatatcacaaaaatgctaagataccatttatttttcattatctctttctttgattaaaacaattatctcttgtaataactttatatatttactattttttacatttattattaaaaaataaaacaatatattaatattctcatttttaatgatttatctatttaatcatatatttaaaataaaaggttctaatttctttggtaaagcctctatcaataaaataacgatttctttaatacttataggcatatcatttaatatccagtctactgtcatatcaatcgatcctttacaatacatttgcaataaaaaatcaatatctttatctacttgatgccctaagtttcgttcaataatttttttataaaaactataaatacaactaaaatcataattaatcaaattattgtaatcattagacttaaatgcttctttaaaaaaagagtgttcattttgaataaactcaaatttcaaacacagcgcttcatacaacgaacatccatttcccatttgccgaaaagatttcaatactagtttttcaaaataccagttcaccaaatcatatttatccatgaaataacgataaaacgtttgccttgtcattccggctttaataacaatatctgtcactgtaatcttatctaatggtctatttttaattaattcctttattgcctgggcaaatatatattttgtttcatcatgtttattcataaatatacctcttttaatttattataaacaaatataaatatctatacaaacaaaaaagctgataaaatcagctaatgtgactcgcttcgtaagccaagttctgtttttcaaacgattatttatctatgcatacgcatccgtcttttagttcaatttcctcaagacgattcccctaccaaatttgggtttcttccttgcagagtttacctcttttcagctaatctttcgattagaatagtttctgtggcactttatggcttatcgaccatactaatggttaggtcttaggcctgtcgttagctcacgctaccatgacttattgattcgtcatgtacaaacactacaagcatcgcagcttgtggaagcctggactttcctctactttcgtagcaatcgttttctacgagtcttctttattttacttatttttttttagaaagcaagtataaagttatttggtactatttattttgattaaatactactttttctaataaagaaagtctttttaaaatatccacattagttgaaagattttcttccatcgcatggatattgtcatcttgaagtgctttttcacgttcaagtttagcaattttgatcttttgttcatttaaacgagcttccaattgatctattttatcatacgatgcatttaacatagcagcgaatgattcataatctttaacgatcatatctaaaaaatgatcaacttcttctgcattatatcctttaaaatcaactttaaattctttagcaactattttttttggacttaacataatttttggttccaaagtaatcaactcctatctatatagtatattgaaacaaaattcttgattaaatgcaagggtttaatatatttgtcatgaattttaacaaaatatacaatgtttaggaaactcgcaagatattatgatattttattttagttatggtataatacctacgtaaagtaataaaaaggagcgattatggttaattatccaaatatgaaaaagacaactatccatcaaaccaaattaattgatggaaaattaaatacccgtcatcgtgggatgaatcttgaagaagatttaaatttaacaaataaatattatcttactaatggcatcgccaatattcacaaaaagcctacaccaattcaaatcgtgaaagttgattatcccaaaagatcagctgccagaatagttgaggcttactttaagactccttctacaactgactataatggtatttataaaggtaaatacttagattttgaagcaaaggaaaccaaaagacaaaactttccttttactaatattagtgttcaccaaatcaagcatttacaaagtattattaatcaccatggaattgcctttgttattattgcttttactcacctaaatgaggtatacttaattgatgcctcatacatgattgaagcatactatcagcccaatcaaaaatctatttcttatgaagaaattaaagaaaaaggccatttgattgagcaaggatttaatccgcgtttaaattatttaaaaataattgatcaatattatttaggaggtctcaaaaatgacagatagctctactacaagacgtaaaaagaagagattaaactggaaaaaaatttttactagttttatcattataattattgtcatttgtctttctggaggatgttttttcgcctggtcagtatacaaagaaaccgaagacttttctgcacagcgacttctttctggcgaagcaagcaaaatttatgatgctaatggagaactaatgtatacatatggtagtgatatcaatggtaaacgggaaaatattacttatgaagatttaccgcaagtattaatcgatgctgtagttgccgcagaagattcccgcttctttgaacacgatggtttcgatttacctcgtattgctaaaacgttgattactaatttagcacattttagtattcgtggtggtggttctacgattacccaacaagtaatcaaaaagtcatatttcccagaagaacaaaaaacttatacgcgtaaaatcagtgaaatcattttagctatccaggcaacgaaagaagtaagtaaagaagaaatcattactttatatttaaataaaatttattttggtcgcagtactagttcaatcggtattgctgcagccagcaaatattattttaataaagaagtatctcaacttactttaccagaagcggccttattagcaggaactttgaattcacctagtgcttatgatccatattacaatcttgatttagcaactaaacgacgtgatatcattttaaacttaatggttgatcatggttatatcactcaagaagaatgtgatttagcaaaaaaagtaaagattgaaaatatgttatcacaatcaagtaccacttcagatagcgcattagcagcatacgttgatttagtaactgctgaagtaaaagaaaaaactggtttagatcctgctgaaacccaaatgaatatttacacatactgtaatcaagatgtccaaaaagaagctgcaaaactagcaaatggtgaaacatatgattacactgatgaagatatgcaaatgtctggaagtatccagtctacgcaagatggtcgaattgttgcagtaattggtggacgcaattataaacttggtgacaaaaataaagcaacattgaaaagacaacctggttcttctatgaaaccgatccttgattatggtttagcttacaaatatctagactggtcaacagttcacacagttgttgatgaaccaacgaccttccctaataactatactcctaaaaactgggacaatagttatcatggttcaatgccaattaaagaagctttagttaaatcatggaatattcctgcaatccaaactttccaagaagttttggaagccgcatcttctaaaaaagtaattgctgatatggaatctttaggcatcgatatgtctacagaaaatgaagaattatctctaccatatgctatcggtggttgggcaaacggtactagtccaattgaactagctggtgcttatgcaactattgcaaataatggtgtttatattgaatcacatactgtcaattatgtagaagttccaagcacaaataaaacttataatatcgataaagatatccaatctgaagctaagcaaagtattggtgaagatgtttctttcatgatcagagaaactatgctaagttattcagatagtggatatggtaattatgcatatttaagcggtattgataacgttggagctaaaactggtacatctaatactgaaagtggtgctagtaaagatttatggatgacagcttatacccctgactatacttgctcagtttggatgggatttgaagaaaaagcattagcagctggaaaaaatacttctaaatacaaagcttatcctggaaaagtagttggtgaactattaagttacttacaagataatacaacagacaaaaaatcataccctgataaacctgatagtgttgaagaaataagtatcattgctggtgtatatccttatgtaagtccaaatgcaagtaccccatctgataaaatatataccggttgggctaaaaaaggtactggtcctagtgaatcagctgttgaatatgatattaacaatttatcatcttttgatgcatcacttactaataatggaaagatttctgtcaaatttagtgaatataaccctgcaagtgcagcaaccgatgaaaatgcaactgaagcaacaaaaatgtatggcgtaattgaatacgttgtcgaagttagtgatccaaacagtcatgaaattttatatactacaacattaagtcagtctgatggcacaattgattatacgcctagtgataaagttaatgtaactggatattatcgcttccataaagctccaggaaaagtatctaataaaattaccaaatctgtaggttcaactaaatcagaaaacaaaatcaattattcaattacttcaaatggaacgaccgttacaaatggaagtactacttcttctaatacggttacgatcaaagtaaacgctcaaaacagttctaataacattagtattcaattctttactcttgatggtagtgaaattaatgatgcatatacttttactggtaatggtagtaaagactttgaattgacacctggtgttcagtatcgtgttaaaatcagtgaatctgatggtactaaaacaattagtgatacagttacttttacggttggtaattctaattcatcaacagaataaaaaagggacaaaataaattttgtccacctggatgatagtgtattttaaatgcctatcatcctttttggtattataatgattttaggagatgactttatgatcgatttatctgttccttctgatacattaggtctttttaattttaagcagtttgttaaaaaagacggtaaaaatacttttaaatatatcttctttgacaattacgactatatcattaatttacatgataaaggcaaacttagggatgtttcttttgataatgttcaaaaaactatcctttgttcttctatccatcttgattatggtctttttgtcgttgccagaaatactctggctttccttttcaacaacagaaaatatcgcaaacaaaagcttcttgaaaaaaagaaaggtatcttctatcataaaaaagcaataaatctcaatatctttacaaagatacaactataatgtgatttttggtgccattgcctcattgcacacttttggtagacctcttgactgaaatccgcatatccatgttctgattgttggcaatagtaaaacttttgacgcgggaatataggttggcgacgatacatcaacatttcacataatcgtttcaactgtctgaataaagtgcatttctttgaccttgattagataatccagcgcagaataccgccgattccacgagaaagccaacaccatttgtcgtttgaaaagtttctgcagctcatagcttttcatatagatcagcaagtctatttcaccggttttctctaccaccgcgaagggatatatggcgtactttttcacctccattttgaaatataaaaagtcgaggaactttcaaaatgaaaatttctcggctatttaaaatattacttactttaaattacatgtagaaaaccatatttactaaactgttttatgaattattttttatttggcattcttgtaactttgcatttaaaaaatcaattagcttcataattttggaaagattgaaaacaggatcaaaagcacccatctctgctctttcactttcagatgcttcatttagaatatcttcgatttcattttgcacaatttctacctgttctttatcccattcaggatgattacctaaaaacactcttaaactaagcaatgtttgtccaatataatttattgcttctggatttgaattgaaatccgacaacagtcttatatacttggagatttcttcatgtgatttttgaggcatattattaaacacctccattacttttgcatgaattgaattaagttcgttatcaacagaaacccttattgtatgcaaaccttgctttccaactttggttaaagtaattttatcttgagcaatatctattattccatactcaaaaaattctgcaactattcgctgaaactccacatcaggaacacaaaaataaggagcatgatctaaaaacaatgcatgattgaatgcataatgaattaggctaatgtcgctttcaaccaataaaattggaccaaagattgaaaatatttgtgcccatgtcaaagaaactggtatggaaatattcttgtaatcatcccactttgaatagcccctaaaagtgcgaatttcattccatggaaactgcataatgagttgctcatatttctctgattgctttttgtcctcaagcagagcttttaatctatcattttcaatccttaaatcgtttatttgattcagtaaatctgaattttcgtaggatgcaactctctcccaaccaggtcttggataatcattaatacaatttactaaagcgataacaacattttcagaaagagctgatggattatcccagctaaaatgactcaccattctatgatgcatcaccttatctctaaatttattaagtttccatttggcatctagttctatatcggatttgttaaccggaagagaatcaggcttgctatgaatgcacgcaattactggaatccctaaattcacagcataatcaaactctttttcagtgtaactaataccatcatcagcttgtgaaccgtatctatttgctataatgataatatagtaatccgtttcatcaagaagccgcttaatataatcaaactgttcctcgtttgttgaaacaaaatgttccataccaacaggaatatgacgaagtttaagaatactctctaaaactgcttgtctctctaattgtaaatctgtatatgtggaactaataaatacttgatatcgtttcatagttactcctctaaacctcaatttttaatctttatgataattttaatatccatcagccaatagaaaatctgctaaatgtacgatctttacaccgttgatattacctgcggcgagctcgtcaagcgttacgacatacttgggatagtggtctttgatttcaagcagattggcaatctcgcggtcagattcttccggcagattgcggcacacctgcacatagatacgctcgtcgcgccgtaccgccacaaagtcaatttctttcgtttcgttcttgccgatatagacctcgtaaccttttctgcgaagctcaaagtatatgatattttcaagcattgcggcaacagacttcggattgaaacccatcatgcagtatttcaaagaagcgtcagcaagatagaatttctcctgcgttttcagcacggatttaccttgcagatcgtatcgctggcagcgataaatcacaaaggctttttccagccattccagataattatataccgattccaccgagagagaacgtctctcacttttcaagaactttacaatagcatttgcagaaaaggtcttaccgacattttcaacaatatactttacaacacggttgaacaagtcaaatttcgtaatattgtgccgtttcgttatatcgctggtgataacggaattataaatgccctcgacaatctgatatgctgcgccctcgtcaaaattgctcagcgcaacgattggaaaaccacccatgcgaatatactctgcaagcaattctttcggcgtgcgtccgcttgcctttttgaactccatatattcggcaaaggacagcgtaaatacagggatagagatataccgccctgaaagataggtggatatttcacttgacatcagcttagaattagaaccagtcacataaatatccgtatcagcgttttcaagcagactgtttacagccttttcccaacctgtgatttcctgtacttcatcaagcagaagatagtaacgtttaccatctgtcattttttccttgattccattgtacatatctttatcggtcataccgtcatcaaaatcttccgaagtgtagcgcatactaataatgtggtcggcaagaacgccactttttatcaaatcatcctgtaacatgtctaaaattgtggacttaccacagcgacgaatacccgcaaggattttcaccagtggcacatcacgataggttttcagtaaatctaaataatggggtctaacgatcatactaatgcctcctttactattagtataccaaaaaacatataaataattaatagtttttacttaaattaaataaaaacttttatattttaatttgttttttggtcttatcataaactttaatcatgtaaaaagcaattcaatttaatgcctcgagctctttcagatatgaaatacagtcgacatgtcctctaaaatatacccgttggcattccatacctttttctgtttttccaagagtacgaatatagagattaggactttgaatacggtattcttcaggaatattctcaatattgccatcgtaaatatcaacaaaacgatcgccatttgagcgtacataaccgttgttggtaaatactttgctttcatcaaaacaaatatcccacctaaaattttcatagtcgatataatttgaaagagcacctagtttgcttgtaccatagcagttgctttgttcaatccaataatagccaaggtcggaagcatcgataacacctggaagatagtcaaaacagtccatattttcggtaaggttaattaagtttctaacactgccctactctcccaagtctaaaaccgcctgccagaaatcctcgctttcatcaagttttataatcttttctacaaggtaattgagctcgcttaaactctcgtattctccaagcaggtcataaatatggaaattatagcacttataattggttaataaacacattagtttcaaaggcttaaaagatgattctaccgaagatacggggaagtgttctatgtctatgccccaaaatcaaagatgaacaaactaagaacgctattgaaaaatgtgttcaatatatgaccagatcaataatatatgaaagcaagatagtaaactatgatgatgacaaaaaagtgattcactggttttatcaccgtcattaagataatttgcatattactttctcgaattgttttaactgttttattatatttattaatttaatttgatttgatttgattcgttcctgcctttttttgtttatataatgtgctaatcaacatcgtgaccgaaagattcttgaagcaaaatacagctataagcataggaagaaggtaaacaaatgattaatctaactaatgaagaactagcagaattattgaggaaaccagaggtaatgataccgatgaaatgcaagagatgcggttataaagaagtaccgaaatgaatactggaaaagtttttagatgaagaaaatcaaggatacagctgtcagtgtccaaaatgcaatggaactatgattaggaaaaaataatatttctaacacttttttagtcgataaaaatatccagccatttcatgtacccctatggttgatatttttattttatacttaaacgaatcgaaattcctattagattatggaaatctttccataatttaatttatagaaagtaaattattatggaaagtaaccagaatatatgttgatatattaatatattcctcattatttactttccataatattatttatttaaatctatccagtatagaagtaattactaaatcatcttgtttaatttcattctttttatttaattcaagtttgtcagtacgctctattattgctttttgtaatatattaatattagttcttacgtacatttcagtggtttgtactgattcatgaccaagaaaatcacggatataatatatatttatatcacattccaatagatgtgtagcttttgatcttctcaaaatatgtggagttatagttccttgaaaaaaatctttattttcttttcgacattcattagtatatttattaattatatatgtaattcctggtcttgtaagtttttttaaacgtgaattcataaacagataatcattattctgcaaatcgaaagctctaatgtactttaagataattgagtttacatttgatgatataggtatttctctttgttttctacctttacctaacagtgagatagtatttcgtttaaaatcaatatcctttacctttatttctataaattcactaacgcgacaaccactatcatatagtaaacttattaaagccacatctcttatacctttttttgtggtcgtatcaggttttgatagtaaaagttttatatctttcatttctatatatctcttttgtttttttatttcttttttaaatttaattttcaaaatatcagtacattgatccagatattcaatattttgatttataatatagtcacataatgtatgaataactgctaaacgtaaatttcttgttctgatagaattttttttataatcttcaagccaattaagatatttgatgacaatttctttttttaagtgacataaagttatatttttttctaggataccaatactttttaaatattcaataaaagtctgtaacgagtatgcatatgtttcgattgtattttcactgacacctctttgctttcttaaataatcagtaaaaaatctactgataagttctgaaaatctactatgtttcattttctttcacctttggaaacaattcatttattacagatatatgagacatatcattaaatttataatatggaagatgaatatagacttctgtttcggtaattttctcatgtccaagtaaacaagataataaataaatatcttggttgacatttataccattactgatcattttttcaatcatatgtactgctgcagtatgtcttaatgtatgcaaactcattttcttattggtaagattttcattatatccaattttttttatgatttttttataatgataataaacaacttctttggtcaaaggcttagaattatcaagttgaaaatataatttattcacaaaaaatacttcattttgatatttttctaagcatttgcacatactttcacttagagggacatagcgacatttattattttttgcatctttaataaatatatatttttttgtaagatttatattttctcttttcaaattcaaagtttcagatatgcgtaatccacaagaacaaagtaatcttataatcaatggcattgttttcttgatatatggtttcaaattttggttattttgacaataattatcgactgctctgattacattataaatttcttcattatcaaaaatatatggattaaactgccgtttccttgcaggtaacgatttctttggtataacatatgcttttttacccatttttacgagatataacccaaattgtcttagtagactggcataggtatatttttgatttgcttctttttttgaaatgatatattctacacattttttcgaaagaactgtatcatctgataattgatgtaattcttgaaactctaaaatcatacaatcaatatgcttcaactgatataatattgctccactatatgaatatcccaaagatcttttataggtaataaattttcgaagttcataatttgatatattatttaactttatttcattcataaaccggcacctccaaagctaaaaacctcaaagtttcaacactaattttagaataagcttttgtactttcagatgtagcatgtcctaatatattagctattgttgtgtttgttttcccattattaattagctgatgtgccaacgagtgtcttagtacatgtgagtaagactttctattttttaaattaattccagattctaggaatgcttcatgaactattgctgtaattctcatttttgaaagctttccttttaatccgttttttggtaaatgagtaaataaatatggtgacgatgtatctgttcgtatttttaaatagtctagtattgcatgttttaattcataaggaatataaagtttgacttctctatatgttttgctttgtacaaatattacacagttgtcattccaatggatatctttaatttttaataaagaaatatcaactgctcttataccgagtaatgagcataaaagtactatcgcatattttcgttttcctgcttcatgatctctattgatagaattgataatacaactgatttcactgtctgtataaaaatcaggaagttgtgtgtttttataggatttaattccataaagcaataacgaataattttgatcgatccaattttcatcataagcatattttaatataagtctcaatttacaaatgagatcatgaacagaaactggtttaagaaatttttttgtaaattcaagataactgattatgatattttgtgtaatcttatccaaagaaaaaatattattaaaatatagataaagaagaaaacgtaaaagataagatttaatagtgctgacagcatttatactatgtgattgttcccaatttttcaaaaattgaaaggaaaaatcaataagattgtttgcttgattattaaattgattatgcatatccaattcatagaagtcatcaataatagaaataactcgcagatatttactccttacatcaaattttccattaaaataaagggactttataaataaaaatagagaatttgaagtgatgtagttaaggttcatgttttcatggaaatttaatatagcttttaatacaatgcaataatttgaaaagcgtggatttcgaatttttaaatgtttcagataagaactaatttctggaaaaacatgtagtaataaaacagactttgataatttatcatgcataaatatgcacctccttcaaagtctaattaccataaatattatggaaagtaaataatgaggaatatattaatatatcaatatatattctggttactttccataataatttactttctataaattagataaaaaagaagctggatttaaagttctttcttactttagggtaaacattaaaaagagatttcttaaataattattaaatataatcattttttgaaatctcttatttttaattacccattatcgaataaaaacctgatttaaaacaacttcttttatttatcattgcaaaatcaaaagcccacgataaaagattacttatctaaatatttctttttgattggatccttacacatatcatttaatttacactctttacagttaggatttgttgccttacaaaaatagcgtccaaaaaaaataaactggtgatgcgatttattccagcgtgagcgttcgattgaacggcataatttcttttcgaccgctaaaacactatcatcttttttagcaaaacctaatcttttagcaattctttcaacatgtgtatcaaccgcaaatgccgggatatcaaaagctactgaacgaactacattagctgttttacgtcctactcctggcaaactctctaattgtttctgaccacttggtactttaccatcgtactgttctatcaatacatttgccatcgctaaaagatttttagctttattacgatacaaacctatcgtctttatgtcctcttgtaactgtgataaagaggcttgactcactgcttctactgttggatattttttaaacaaagtctctgttaattgattgacctttttatctgttgtctgtgctgataacatcacagctactaataattgaaaatcagtttcatgattcagctcacaatatgcatcaggaaacaattcatcaaaataatctaatactcgccctgttttttctttattcattttcccaccatttatactcactaattggaactgtccgttttggttcatcctgttcaatataacgctgttttactcctgttttagcccaattagaaagtattccttcaatatatctaaaattaagtacttgacttttaacagcttcttttaaagctttaacaatcatttcatcactatagttacaattcttccaatctttaataatattaagttcgattggtgataatgctcttgcaaactgttcttcaaaaatactgatcaaatcaacttctgatgctttttcttcgatttccttattttcacataataattttttttcaagttcatttaagctaatagaacccaaacgattacaaatcaattttttatttaataacgacgctaaaaccttatccagctcttgatttgacaacactgaataattctgaatcatctgtggtgttacagttttaataccaatatctttcaatgtataaacaatcaataaaatatgacattcattatcatcaatatttaactctttagctctcaatagtaacaaacgactaatatcaacacatttattttctattaattcctttaacataaatctacctactattatcaattcgataagcctttataaattcaccactgtcaattccataaaaagcataaatcaatgaatcttcaccacgatacaacaagctataaacaaatatttcattttcatagcctatctcaacatcatcgggggtttgcttatatttctctttaaaagcatcaatacattcctgctggtctacaacatctccgctatatgatttaataaatcttttcttttcatcaaatacagcatactgttgtttttcacctttttttgcatgaataatataataacttttctcaccgtcataacgattaaaataatcagcgctgtcataaccattttcagcaacaatctcattttcaatctttgcaagatcatttttgtgtcttgaatatggaacatgtacccaaagcatataaaaactaactataataaaaactaatatcaaaaaagctattagaatattaaatctatttctacgtaaaaatttcaaaattccaccaactttctatgcctattatactatcaatttagcgattataaaagaaaaattgtattaatatatctgaactgatcgctcaaaaaaatcaaagccctgcagctttgattttaatgaattaatcacgatcattacctaaaacgatcaaaacaattctaagtaatgataaaaccgttgataacattgcagcaacatatgtaaaagcagctgcagataacattgatttggcacctctgtattcatcattagtcaaataattagttttcaagatctgtaacgctctcgatgaagcatcaaattccactggcagtgtaacaatttggaacagcaggatccctgacatcaagattactcccagccaggcaatattagtatttcccattaataaaccaataaatacggcaatccatcctaaatactgaccaacattacacaatggcaagattgcatttctaaatactaatggtcgatatccaactaaatgttgaatggcgtgaccacactcatgactcgctactgctaaagaggcaatcgatgtaccatcatgaatcccttgagacaaattaactgttttattacgtggatcgtaatgatccgataatcttccacttatgcgattgatttgaacatctctcaatccatttcgatcaagaatttctctagctaccatcgctccagtcatttgtctgctattaggtactttttcatatttattgtaagcactgcttacttttaattgagcaacaatcataattactgatccaatggcaactaaaagataaccaatcatataagttgatgacattggataataaaaaaacggcatttttctcaactcctttgtttctattatacaccttattattaacttattattaataaataacaaaaaaagcaatgattaattcattgcctcttttaaacgattacttggtttaaatgtaacagtcttgctggcaggaataatcatttccttttgtgtctttggagatattcctttacgagctttacgatcatttactttaaacgttccaaatccagagatcaaaactttatctccttcaataacactacgtgtaattgtattaaaaactgtatctactaaaatctcggcatcttttttagtcaagtttctttctttagatactgattcaactagttctttcttattcataactacctccatattctaatacctcgaaagtataacattaaaaattaccgatttcaagcacttttataggacaattgcaataacattacttttccctttatttactatttttgataaaatatcatgaattctaagactcgcattttctggaatagcattcagtttgatatacatcccttcttcaattaaatctcctaatttacgaccaaaaacatcacaatcaaaaattgcttgtttatcgtttccattagaatttaaatattcgataaatgcttctgcttgttcttttgatccgattattggctcaaacgtactttcaatatctactttgatcatatacgtagttcctgctttagatactaacttcattccatagcgcggcccttgtttaataatttctggttcacttaattcaatttcatcaagttttggtattgcatagccatagccagtttgtttaaccattctaatggcattagaaaatccttcgtactctttcttgatatcaaccaattcttggataaatgttaaaaatgtagcctgatcaaaacctttatcaccaattatttcttctaaaatttcattgtataaaccatcacgctcttcgatttttaaagtggcactagatgtacttgtgtcaattcctgttaaatatgctttatcaacaaaatcatattcactaatggcatcgccaattctttctacatctttaaattttttgattgactgcaaagattcttttaatgatgtatctaatgtttgtttcaaccaatgattattagacatcattgccagccatttaggtacttcaattcgtacttcactaattttaaattcatataaagcatcttttaataaagaaacaatttgcggctcttccatatttgtaacatccatcgataatactggtacatcgtatttttctgttaaacgttcgtattcttttttacaagcaggactatttacatccttactattaatgatgacaatgaatggtttatcgatttctaataactcttcaataatactgtcggttgcttcattataattagctcctggaatatcacaaatactaccatcacttgtaattacgattccaatcgttgaatgatcctgaattactttttttgtacctactttagctgcctgatcaaaggggatcgattctaaataccatggggttttaacataacgaatcccctgatcatcttgatatcccttagcaccttcaataacataaccaacacaatctacaagacggacattgactttaaaattttcatccatgatcatctctactgcctgattaggaataaattttggttcaaccgtcattatcattttacccttaccagactgtggtaattcatcgattgctcttaatttagcatctttatcttcaatataagggataaccgccatttccataaaacgtttaataaatgaagacttcccgcttcttactggtcctaccacccctaaatatatgtccccatcgcatcttttagcgatatcatgtaagatatttttcgtttccattgtaaactcctctcttcgtcttatttatatgaaatccacctatatttagaacacatctaaatacaattttgttataataagttataaaggaggtaatttatgtattcttcacttgaaatagaaaatcagtcgtttgaagatttatatttaaaattctgtgggatgcaggaatgtaagcctgattattcatatggtcctgctataagacaaaactatttaattcattattgtctaaagggtaaaggtgaatatcatgtaaataataaagtatactctattaaagctggggatgcctttttgatcatgcctaatgttgttacatattatcaagctgatcatgatgatccctggacatatttatggatcggttttgatggcaataaaagtcgtttgtatttgaatcgctgtaatttaaatgataataatctggtcattcattgtgattatcttgatgaattaagaaaactgacaatttcgatgttagctcattataagcttagttatagtaatgaattatatattcaaggacaattatttactttcttttcttatttagctaaaagtgcaaatgttaattataaaacaaataaaactaattacaatccttatgttgataaggctatcgagtatattcaaaataattatcaagatatggtaaccgtaaatgaaattgctgattatttatcgatcaatcgcagttatttatcaacgctttttaaaaaatatctacatctttcaccacaagaatttttattgcgctatcgcatgatccaagctgaggaactattgatcaatactgatcttactattaatcaaatcgctttttcctgtggctatgctaatcaattatctttttctaaagctttttcaaacactcacaatctagctcctcgtgattttagaaagcaaaataaaatgatcaacaactctagaatgaatgatcctcatgctcaaaaatagacgccaggcgtctattttgctttaataatatataatctagataaataatctccattagttccatcataagtctcacgattttcaccacaagaactgtcactcgtaagtaagccaagattcatcaattcatcaccataatgatcagtttcattgattgatacatgatactccttattaggatctaaacctaatagtttaactcttctaaaaccttgattaacttcttgtaatggtcgataatagcctacgatcgcagtatttaaatcatttgaaactaccatccatactgtttcattaccttcgaatggactttttagacgatagaaagttccaaactgaataatttctcgatattctttcataaactttatttgggcaatgatcttatcctgctcttcttgacttagtttatttagatccaattcataaccaaaagttccaaaataagctacgtttgctctagtctcaattggtgtatttctaaatacttgatgattaggtactgccgatacatgagcccccattgctgaaattggataaacgtaagaagtcccatattgaatctttaatctttcaacagcatcagtatcatcactcgtccagcattgtggtgcataatacatcatcgctggatcaaagcgggccccaccactagcacatgactcaaataatacttcgggaaaacgtgatgttaatttttcatataaacgatatactcctaaaatatattcatgcattacttttccttgtgaagaaggactatgaatacttgaataaacttcactcatacaacggttcatatcccatttaatatatgaaatttgtccttcctcgattactttggccatcatctcataaatatactcaactactttaggattagaaaaatctaaaacatattgattacgaccatgacaactatttcgattcggtgtttttaatgtccactctggatgtttgcgatacaaatcagaatctttattgaccatttcaggttcaaaccataatccaaacttcatattcaaatcgtttatttttttagctaaaccactaataccattaggcagcttttccaaattaggataccagtcccctaatcctgctttatcatcattacgttttccaaaccagccatcatctaaaacaaacagctcaattcctaactttttagcagtaacagcaatttccatgattttttcctcatcaaaatcaaagtaagttccttcccagttattaacaaggattggtctaacttgatcacgatatcttccccgcgctaaacgtttttgatatagagagtgataagtttgcgacatcgcatttaatcctttatcactgtaaaccattactacttctggtgtttgaaaagattcattacttttcaattcccagctaaagcaatggggatgaatccccatcataacccgcgttacattataagtatctacttcaacctgggctaaaaagttaccactataaacaaaactaaaacctaatacttcaccatcatattcattacaattttctctttttagagcaataaagggattaaaattattacttgaacagccccgaagtgaataaattgattggattccatgttctaatttacgatttttaacatttctttctctagaccaggcccctgttaattcaatcatttcataattatgatcaggtagatctaaagacatactcattatctgatttaaaactaatttttgctttccccaatttttaatatatgcatttcggcaaataactggcaaatcttcataaatcgtatagcttaaaatcaattctgtctgaatcacttcatcgtataaagttattaataaagtttgtgcttcactatcattttctacatacgtagctggcaaatctgttaatttcggctttccttttataatttgatgatcttgatatctaaaatcaagaattctactaccattttcctgaagaatatcaattgccggatggcgcatatcgcctgatccatacactggatattcttgtttaatatgttctaatgaaaatgttaagtcaccttcaaacgtacatgatgccatgggtcttggtcttgtttcaaaaagatgatcaaagttttctcgatcgtgaataactttaccataatataattgacctaattgatcattttttaatactttaaaaatatagctaagttgtgaattatataaatgaaatgtttgtgatgatttatgaaattgaatcggcataattaccctcctgtaaatttttactttgattattttctactactctattttcaacatcttcttccttttttaaagaaagaatattcataattctagtcatatatttaccatttaatatataatattttttataaataataaagcttataataacaaatataattggtaatccaatcataatgatgcgcataccattgatcattgcagctgattgaactgcatctggaagataaccagtagcatctaatgcaaaacctgtaaataacgatcccaaagctgcagcaaatttaactaataaagtttgaattgaaaaaataactgattcattgcgagtacctaatttatattctccataatcaacaacatccgctaaaacaacagttaccgttcctaactgtaaaccagatcctaattttacacaaattcctgcaacagcagttaaaatataatttttaggaatgacgatccctattattaataaaacgatcaaaccaataacgggaattccacttgcaaggccataaacttgttttttagacattcgtttagctaacttgggaaagatgatcaatccaaatatttcagcaaatccagcaaacatcgtaaaaatagagaaaagacctttatcaccagtaacatagataaaataataagtttgaacaccactaatacagttcatcgcaaaattaaaagtcaatataacagcgattgcaactagcaactgatcatttttcttaataacctgaattatttgtttaaatgatgttttttcagatttttttgtttctatccggtctgctgatctaacatttactacagtgattccgatcgttataataaaaacaattgcaatcatccatgcaaaacgggtaaatccatcctgggcatttcctttgcctaaaaaatccatgatttgtagaccaaagccacctactaataaagaaccgccaattgaagcaaaaattcttggaataactgctattttatcacgttcttcaagatcggtagtcaagtttggtaacattgaccagtaaggaatatccataactgtatatgtcattccccaaacaatatacataacagctgcaaaaacatacaatgttgttcctgataatccccaattagtaaataagcaaactaaaacaatcgcattaacaacggttccaatcactaaccagggcctgaatttgccccatttagtatgggtattatcaacgatcattcccattcctaaatcgtttatagcatcccaaaacttagctaagaaaaataatgttcctacaaaagctgctgataattttaaaacatcagtaaaatataacatacagtaagtaaaaattatgccacagcacatatctttaccaatggccccaataccataagaatatttttctttaaaagacaatttatcactattcattgtattatttcctttctatcgttataaaagggctcttagcagcaaccattccatattgatcaacggttatgtcccttctatttaaattagtaaaaacaaagggtgtagcatcaatacagtgatatttctttaaaatcattgtgtcaaattcaattaacttatcaccctgcttaacatttttacctgcttcaacaaatactttaaaacctctaccttttaaagtattcgtatctaatccaacatgaatcaaacattcgattccactaccttttaaagcaatggcatgctttgcttcaaaaataaactcaactttacaatcatatggtgcataaacaatatttccagttggaaatatgacgacaccttcaccggtcattcctttagaaaagacctcgtcaggacaatattctaaaggacttacttttccttcgatcggacaacatattttaaattcttttttaaaaatccccatatataacctccgtttaattaaaattctgtaagcgcttttacattttaaattataacatctagatatattatctaatagtattgaatgtagttaaaatatgtcttaatgttatatttttattaaaaatacccttgattatcttcatttatttaaagaaatataagtcatcgcaaaaaacgaagttaacattatgacatatttattgaacattttatctagttttaaaaaataatatttatctttaactctataaacgtttgtattagaataaacaagaggtgaattatcagatgaatttttcaaaaagaatggatttatttcctgaaagtatttttacggttctagcaaaaaaagccgcccaaagaaaacaaagaggattagaagttatcgattttagtaccggtacacctaatatcccgcctaataaaaatattcgtgaagtgttgtctaaagcggccttagatcctaaaaattatgtctatgcaattaatgatctgccagaattgatagaagcagtgatcaactggtatcaaagaagatatgatgttagtttaaataatgatgaagtctgttctttgttaggttctcaagaggggttatcacatctagcaatgactttgatcaatgaaggggatactgtattagttcctaatcccagttatcctgtttttaaagatggtcctttaattgcgggggcacgaattgttgagatgccattattaaaggaaaataattatttgattgattttaatgcaattgataaaaaagatgctgccttggcaaaatttatggtcgtttcttatccaaataatcctacttgtggaattgctaatgatgcgttttatcttgaattaattaaatttgcaaaagaaaatgatatcatcgtccttcatgataatgcatatagtgagctattatttgaaaaacccggaaaaagctttttgtcttatcctggagcaaaagatattggaatagaatttaattcgttatcaaaaacatatggcctagctggagcgcgagtaggatttgctgttggtaataaagaaatcgtaaaacaaatcaagactttaaaatcaaatatggattatggtatgtttattcctgttcagttagctgcaatagaagcaattagtggtgatcaaagctgtgtggaacaaacgcgcaatgcttataaaatgcgtcgtgatgcctttttaagtaatgcaaaaaagattggctggaaaattgataagacaaagggaacgatgtttatttgggcaaaaattcctgataaatattcttcttcaatagattttgtcaatgatctatttgaacaaacaggtgtcttgtttgttcctggcaaggcatttggtacatatggtgagggttatgtcagaattgctttgattcaagatattgaagttattgaaaagacttttgcgatcatagctaaaacagatatttttaaataaaaaagagatttttgaaatctctttggttcttactcgcttatgggtaaatgaacttattagacagcacaagaaattgtgctgtttttctttagtttgtatttcttgtttttgggcattttgatacaatatatgtatggatggtgatacatatgaaatataatgaaatcagtttgaatgaaaaaatctttggtaatgacttcattgtctatgactggaaagaatcagataataaaatcataatatatgtgaaagcaacttctcatgatgatgtatgtcctgtgtgtggttctcctacaagttctttacataatacctatcatagaatgattcaggcttatcctgttagaaataaaacaacttttattgatgtgattgcttataaatatgactgtactaatgacaaatgcaatagaaaggttattatgcagaatcttccttttgtttctccctctcaaagaagaacagatgagcttaactgtcttatccttgcagtttctctctttttaagcaatgaaggtgccagtaaagtactgaaacttcttggggtcaatgtaagcaatgactctatcaaacgcctgactgataagatcattattgaagatgaccctgatgtcgagtctattggaatagatgatgtagcgatgagaaaaggaaagacttatgcaactgccatatatgatatggaagatcatcatcttattgcacttttagatggaagagataaggatacagttgttgaatggctaaaaaatcatcaaaaaataaagattgccacacgtgacagagcaagtgcatacgcttctgcaatcagtgaagttttacctgaatgtatccagattgcagacagattccatcttcttcaaaacttaattgacagaatgaaagatatttttaaaagagaaataccagaaacagtatttataaaagatggaaaggtattggaagtgatatgataacctcccagtagacagtgtaaataattaaacactgactatgggaggtttttatattgggaagaaaaaataaatattcaaaagaagtgaaattaaatatagttaagcgttatttgaatggtgaaaaatcctttcgggctctcgcggacgaattacacaccagcagttctctcattcagcgatgggtaaggatgtataaggaatacagagaagctgcattcgatacaaatcaatctaataacatatatactaaacaatttaagcataaggttgttttggcttatttaaatggggatggatcgtatgctgatttgatggtaaaatacaatatttcttcagattccactatcataaaatgggtaaatgattataatagtcatatagaactaaaagattatattcctggaggagaggatatctatatggctaaaagcagaaaagtaaataaggtgttattcggtggattattttaattaaaataatccaccgaataacatacaaaagaagaacttataaaagctatagaagattggattcattattacatgtatgaaagatatcagagaagatatggagtcaagacaccatatgaagtcagaagcgaggccttgactaatgaaataccaaagcaatatccaatacctgaaaacaaaagaataacaaaatataagcaggaacattacacaggcagttcaactttaagtacataaagaaaatgaagttgtctcatcgacaacttcatcaaaaacattttaattatttcacctgtctacttgacaggggcggttcaaagaggaacctcaaaaggttccagcattaaaaatcgatccaaattcaaaggaacttgaaaaatatgactatgacaacagtatgccagttgataaagaaggaaatatgattgattttgatgcggtatgttatgataaaaacgataaacaacacagacagcaggctgaaagccgtaaaaaaaacagaaaatgatcattgacattcaaaaaagatgggaggaactcgaaaaaaagaaatacacaacaatagctaaagaattttcaatatcaaatattgtagctaaaaaatatgtaaatatgagtgaagaggatattcaattgttggacagtccaaagaaatacaaacaaagaaaaacagctacagatgactatatcaatatgatctataaaatgattctggatggaataaagccagagataatctttagctatgtcattatgaaaggatataaaggtacgtggaagtcattggataacagaattgtatacttattaaaaaataattttagtatttctctttcaatggggtggcatattaagtataaatatccagataatatcatcatcataaaaagaaatgaaatattaaaatacataacaactaaaaatgagaaaacaaagaaaaataaaacagttgaaaaaaacattcaaataatcaaggaaagatatccaattataactgaactagaaaaaatatatgattcgttttacagcacgatcaaggaggcagatactgatcagctagataagtttattgataattatagagaatcagtattaaaaggatttacagaaggtatagaaaaagatattgccccgatcaagaacgcaatatcttatccatatagttcgggatttgttgaaggaaacaacaacaaattcaaactcatcaaacgtattttatatggaagaagcaaaatagtcaatctttttaggaaatgttacatacaatttttaatgaataataaagattttaagctaattgatattttagaacacaaaaacagcacaatttcttgtgctgtctaataagttcatttacccataagcgagtaagaaccatctctttttagttacctatataatagttttaataattattttatggtatatattgtcaatttttttaaacaaaagatgtttgactttaaaattatttttttggtataattatattagcaattggcacgatacaagctataaatatgctgttacgaaacagtctatgcttgtatcttttttatttttgatgcaagttatagacttgcatctttttattgtttgataaatataaaatggaggtaattttattatggaacaaacacaaacaaatgattttcttgaaaaagaaagtcttggcaaactaatgaaaaaatatgcaattccttgtgtaatttctttattagttgccgctctttacaatattgttgaccagattttcattgctaatgcgagctatcttggttcttatggaaatgctgctaatacggtagtatttccgcttacagtagtcgctctttcgattgcaatgatgatcggtgatggctgctgtacttttgttagtattagtcttggagctaaagaaaatcaaaatgctcatcgaggtattggcagttctattattacagttattgttgcaggtattattttgatgataatttatctgctttttcaaacaccaattctaactgcgtttggagcattagttaatgatgagacataccggctttctaaagaatattttttctggatcactcttggtatcccgttctatatgtttggccaggcaatgaatccaatcattcgttcaagcggtagtccaagttttgctatgggaacacttttaattggagcaatactaaaccaatttgcatttatgtcttaagttgggggatgatgggagctgcagtggctacaattttgggacaaattgtatcagctatcgtctcagctatttatctagctcgcatgcagtctattaaaatgagtcctgatagttttaaatttcgagcttcacttatgaaaaaaattctgcctcttggtattacaagctttttatcacaaatttctatcgttctttctatggctgcggtattaaatatggtagcaaaatacggcgctctagatccaatttttaaacaagcccaatatgcccagattcccacagcagttgttggaattgttatgaaattcttccagatcgtaatttcaattgcagttggcttagcagctggatgtattccaattgcgggatataatgttggggctaaacgaaatgatcgtgttaaaagtctaatgaaattattacttatcacagaatttattgttggcttgatagcttctgccctttttgtattattcccacaccagtttattaatatttttggggctaaaaatgaaagtatttattatactgattttgctgtaaaaacaattcgtatctttctttgtttattaccactttcctgcttaaataaaggaacttttatctttttgcaatcgcttggtaaagcaaaacaatcaactatcctttcaatgatccgtgaaatcatttttggtgttggtctaccactaatattaccgctttttatgcaattagatggtgtgttattctttatgcctattgcagatgttttaactgctattgcatcaatagtagtaatcattaatactaataagactttagaccagttaatagatatgtcagaaacaaaaaatgcacatattgaaagtacaactaatgaaacaccattaacagattacatcattacgatcggtcgcttttatggagctggtggaagaagtattggtaaaaaagttgccaaacagttaaatattccttattacgattcaaaactacttgaaaaaactgctcaaaatagtggcttaagccataaatttttacaaagtatcgatgaaaaacctattgatagcagcatgttatattgttctgttggttttatgagtaatggttatgagttaattgccagtcaagctttaaaagcccaaagagaaataattgaaacagtagctacaaatggtccttgtatcattgtggggcgttctgctgatcaagttcttgcaggaaagcataaaatatttagagtatttattacttctagtaaagaaaatcgtattaaacgtattatgaaaagagattcattgaccaaatcagatgcaaagaaaaaaatatctaaagtagataaagaacggtcattatattataaccagcgttcagaaaaacgctggggtgatgcagctggttatgatctttgtattgatacagactggtttggtattgacggagctacatctttaattgttgaagcagttaaaaaacagtaaaactattaacaattaaaaaataggtacttataaagtacctattaccatggtcttggtggacgtggtggccttggaccgggtggtggcggaaatcccggatgccatggaccaggttgccatggaccaggttgccacggtggtcttggtggtggtggcggtggagtaaacagccaccagaaccaaaatggcggattaattaaaccataaggctccttttctatgaaaatttcattttgaaacggatccattataacacctctctttactatatcttattccaattaataatattgttataggcagtttaaataaaacaccaataataaaagacatcttcaaggatgtctttttggttattattttattcgtactaattctaaatagctagtatctcccataagtcctggtgttcctcccgtaacaagaatcagttcacctgattcaacaccattttctcgagcaatgagttcagcatagtccatcataactgaacgtgtcgacataaatttacagataacgggtttaaccccccaattgattgctaatgctctcgttgtttccaccattggtgtagctgcaataattcgggcttcgggacgatatcgtgacatttttcgagctgtaaagccactttcagtaaatgcaatgattgccgctacttgaaattttgaggcaatttctgcaacagacatacaaattgcttcagatgtatcttgaggcgctgttaaaatagcttgacgatgtaaagcatcataatctaaactttcttctgtctttaaagcaatccggctcattgtcataactgcttcttgaggatataaacctgatgctgattctccggataacataattgcatcagttccatcaaaaatcgcattagcaacatcacttacttcagctcgagtaggacgtggattttgctgcatactttccaacatttgtgttgctgtaataactaattttcctttatctttacatttgctaataatttctttttgaatcaatggaacatcttcagcaggcacttctacacctagatcaccacgagccaccatgattccatcagctactttcaagatttcatcaatattttctacgccctcactattttcaattttagcaattatttgaatatcagaccgcccattttcaattaataacttttttacatcaaatacatcctgggctcttcttacaaaagaagcagcaacataattaaatggctgtccacatccaaaagttaaatcatcaatatctttggctgataaataatcaaatcctaatttaattcctggaacattaataccacgtttatttttcacaattccattatttgcgcacacacaaacaatatcggttccttcaacatgatcaactaataattcaacttggccatcatttactaaaataaatcccccaggtttaacatctcgatacaattctttatacgtaattgtaaatcgctcacttgtaccttcaatatcttcttgacaaatagtaacaacttgaccttttttaaattccgcttttcccccttcaaaatcccctgttctaatttccggtcctttcgtatctagtaaaattgctacagaagtatttaattctttattgatttcatcaagtaatttaattttatttaaatgttcatcatgactaccatgagaaaaattaagtctcattacattcattccagctttaactaacttagttaacatctctttattatcagatgccggtccaattgtacaaacaatttttgttttactcattttttcattttttaacatattatcattaccatccttttttctcttcatacaaatattatagctgattgaaagtttacttgcgagactttttaacaaaatcagcctgctcaaaagtaaaaggagctatcatgctcctataatactttcattccaccatatttgcgtacttttaatacatggcatgaatctttaccaaaaactttttcaattttctctttataaacaggtacaaattcatctttaacaaacgcctgaatcgttcccgcaaatccaccgccatgaactcgacaaacaccattatcaccgataattttttctgacatcgctaaaccaatagaaacactttgattttgcacatcacagtttgcataaacattttgtaaaaacttataagagctgtcaccagaagctttgaccaattttttaaattcttcaaaatctcctgtatttaatgcttcaacttgttttgcaacccttttattttctgcaaatagatgaatcgcccttaacactgcgcgatcttgacaagcagctcttgctcccgcaatatcattaaaaaatgcttcttcatcaacttcacgtaaaaattctttaccaaaataattagccacttttttcatttcactagggattgctgcatattcatctgtcaaatcagcatgagaaccttttgtatctacgatacataaactatgtccaaacttagaaaaatcaacatcaactttaacaacaaccggtttttcaacatctttaaaatcaatattgatcaaacttccaaccgagctggcacattgatccatgagaccgcatggtttattaaaataaacattttcagcatactgccctacttgagcaatcaatactggatcaattttcatatcattatataatccagaaataatcgttcctatgatcgtttcaaatgccgctgatgatgataatccagctcccattaaaacatcactagtaataaatgcattaaatccccctacttcatatcctaattcttttaaacgcgcacatacccctctgatcaaggcttctgatgtccctacttcactttcctttttttctaaatcatttaaatcaattggtgcgatatcaaaatcatctgatagcactttaatcgtattttctacctttcccactacagcaatcgcatcaagattgaccgctgccgccaaaacacatccatgctggtgatcagtatgatttccaccaacctcactgcgtccaggagcgctataaatttctatttctttgtctccatatagatcaatatatttttcgattgctttgatataacgagcttgatgataatctaataaactttcatcaacataaatgtcatttaataaatcgttatatttattattttttaaatcttcttttacaattgttgctttaatcattattcaatcacctcaaatttatatgatgtagtttcatcatatgtttcacctttctttaaaattgttgttggttctttttcaatatttattgcatctggtaaattctgtgtttcaatacatactgcatagcgccgtggataactaataccatatttaccaattcgaccatctaaataattagctgtatatatttgtgctccaggaagagttgtatttacagtcaattttcgacctgttgctggatgatataattcagcttgatttttatcttgattaaaaatgaacggatgatcaaatccagctcctaatctgatctgttcatcatcactatcgataacatcaccaattctagtcattgtattaaaatcaaatggtgttccttttactttagcaaattcaccagttggcaaaccatcaggatcgatacatgcatatttatcactatgaactaataattgatgatcatagatatcttctttagcaccagataaattaaaatatgagtgattagtaatattgataatcgtatcttcatcactagtagctagatatctaattattaaagtatttttatccaaagtataaattgctttaaaatttaaattaccaggatatccttcttcaccatctttagataaataactgaattcaatactatctccttcaaatttatagtcaaaaacttgataagaaaaacctttgattcctccatgtaaagaatttggaccattattaattggtaatgtatatgttttatcatttaaagtaaacttacctttaccaatacgattagcagttcttcctactaaagcccctaaatacgcatctttagtctgataatcactaaaatcatcataccctaagacaacatcatcaatattgccatctatatctttcattaatacttttatgatcgtacagccataattagaaacgaccactgttaattcatcatttttcatttctatcaaatcaatttgctcgtcaattttttttattacttgaatcatcttattctccttccaatactaaattaacaaaattagttaaaccatcaattccttgatcatccattttaaatacccccgcatcctctaaaaccgtgacaaacttgcttgttactgcctcttttaagatttcttcaacattttcttcactaaaatcatagttattaattaaatcttggtaccagtcgtagtgcttttctaattctggataatcattaatattcgctttgttgagtaaacaatcacctaataattttaattcatcttttaatcgtgctggtaaaatagctaaccccattacttctatcaaaccgatattttcttttttaatatgatgagattcttgatgcggatgaaaaataccatcaggatatttttcactagtacgattatttcttaatactaaatcaatttggtatttatcacctttcatccttgcgatcggagtgatcgtattatgtgggatatcatcactataagcaataatatctaagatcggttcactatattcacgccagtaatttaaaatatcatttgataattgaatcaattcttctttgttttctgaagttagtctaattgttgataaaggccattttacgatctcaataatcgtatgtggaaatttatcacactttaatgttttcaatacttcagcattttgaatcgggaattcgtatttacctccttgataatgatcatgagataaaatagatcctccgacaattggtaaatccgcatttgaaccaatcatataatgagggaaaatatctaaaaatgaaaataaattcttaaaagtattttcattgattaccatcggtttatgttcttcattaaaaactatacagtgttcatcataatatacgtatggtgaatattgtaaataataattcccagtttctaattttaagggaatgattcgatgcgtttgtctagccgcacgatttaaatctcctttaaatccaacattctctttacatagtaaacacttaggataaccacttgatttaactaatttagcttttgcgatttctttagggtctttttccggcttagataaattaattgagatttcaatatttccatatttaatatattttttccagcgaatatttttatctgttctactttttctgatatagtttgaggcaattgatagtcgataataataatcagtagctaattgcggattgattttatatttttgtttaaatgtttcaatgactgtatgaggtcgtggcatgatacagttcattattttagtatcaaataaatctcgacttgtaacatcattttcaattaatccttttactactgctttatccaataatttttctaaaattggcgtagctaatggaaaatgttcgttgattccttcatactcaaaattatcttcctttaataaatccaacaataaatttactgaataatcacattcatcttctgttatcattcctttatccaaagcaaactggatcaattgatttatttcatgattcatatattttctcctctcttatagacagttttattttatcgtttatatagtaaattgtcaattattttcactaaaatataagtaaatttttacctattagttgactaaattttacttagtaattataatataactataataaataatcattatagctattgctgcaacgatgataaaatttacatactagatatcctaaattgccatatattataaaaataatttctctactggaacttttatattaacaaaaaatagggtataatattacaaaatagataaggaggaaaagcatggctacaattaaagatattgccaatcttgcaaatgtttctagtgctactgtttcacgaattcttaacaacgataaaacattatcagttcctgaggaaacaagacgcgctgtttttaatgcggccaaagaattaaattatacaaaaaaaagaaaagctactaaaaatgattttaccttgggaattgttcaatggtattcattgcaacaagaaattgatgatccatattatttacaaatcagacaaggaattgaaaatttttgtttacaaaatcaaattagtgtaatccgtacttttagatctgatcaaaattatcttgaagctctaaaaaatgttaacggtttaatttgtattggtaagtttaatgatcgtgaaatcgttcaatttaaaaaaatttcaaacaaaattatttttttggatatgataagtccaaatcatgaagacagtacaattactttagattttaataaagcggtaaccgatgctttaaaatatttaaaagctttaaatcataagaaaataggttttttgggtggaaaagaatatatagatgacagtgtcttatatcatgataatcgcaaagaagtattcattgatttttgtaatcaaaacaacatcatttacgaaccatatctattggaaggagaattttctaatgagtctggttatacgatgatgatcgatatgattaatcaaggtgatttaccaactgcaatattttgtgccagtgatcccattgcaattggtgccttaagagctttacaagaacgcaacattagagttcctgaagatatttcattaattggttttgatgatattaaagctgccagctttacaacaccacctttaactacagtttttgcaccagctgatttaatgggagaatatggcgctaacattgtatataatcttttaagtaaatattcttcacctacaccagtgcaaataactttaccttgtgttttaattgaaagagaatcttgtaaagaagtcgattaaaaatcgatttttttatttgaaaaaatatactaggagattctagtatgttcatgtcattgataaagttatagattgatcacaaatctatcactatcattagtctactttttacatttacagttttctcaaatgatgttcttattcgttcgcaaacctactatcacataaaacgcttatctttcatgaaacaaatatttaattatttaatctactaaattaacatttgctactatatatttttaaggcagtaaacaattttatttgatattgtaacatctattttcatatgatactcaattataaattccttaactaactattaatttatagtaactttatatttaataattttctaggtattatgtatataatttggagatgattaaatggactatactaaacttggaaataatattagaaaagaaagattaaaacaaaatctaacaattgaagaactagcttacaaagctgacattacacctaattatttaggtaagattgaaagagcacaaagtaagttaagtttagaagtacttataaaaattgcaaatgccttaggtataacttctgatgatatcttatctcatgaatttcaaaaagtatctaaacattctatcgataaaataaacaagaatcttgctatcttagcacaaaaaaatagtgaagatattgaattattaaatgttatcattgattttattattaataaaaatagttaaaatatgactattatttagatacaaattatatatgtctttttgactatctttttatatcttcttaaatgtccgcaaagccttattttataggctctacgggcattttgtttttgtggtaaacctcacatatctaggtctatcttcttatattttccctgtcaatcgtggttaaaatcgtggtaaatacttcttatgcgattagacgctgaacctctgattttgcggtatctatggacgcatgagcataccagttcattgtgatactgatgtttgaatgtcccatgatatactgtaaatctttcgggttcatgttcctgcttgccagccttgtgcagaatgtatggcgtagcgtatgcggtgtgatatgtggcaagggattgtccttgtggtgcttgttgtatttctttaccattcggacaaattgttattcggtggattattttaattaaaataacagctatttagtcaaacaaaaataataaacctagaaaaatagttaaaataatttgataaaatgataggcaaattattttaactattttattattatataaaggagctgacatacaaaaaaagaaagggtcattggatcgcggttcttactcgcttatgggtaaatgaacttattagacagcacaagaaattgtgctgtttttctttagtttgtatttcttgtttttgggcattttgatacaatatatgtatggatggtgatacatatgaaatataatgaaatcagtttgaatgaaaaaatctttggtaatgacttcattgtctatgactggaaagaatcagataataaaatcataatatatgtgaaagcgacttctcatgatgatgtatgtcctgtgtgtggttctcctacaagttctttacataatacctatcatagaatgattcaggcttatcctgttagaaataaaacaacttttattgatgtgattgcttataaatatgactgtactaatgacaaatgcaatagaaaggttattatgctgttatttagcactttatattaactagaatttatcaaattattttaactggctttttccattattttgactaattagttatgacaatcacactattttacttattcccgtcaaattacgccaactataatttcaatataaaaagatagtaattttgccttttaacagctaattactatcctcttttaatattaaactttatactgtattctctgatgaaaattcaacgttatgcctggtattgtgctatatgagcgcttattatacttaatccttttgctatcgtcaatccatcaataatactgttcatataacaggctattttttcactgttccagaaaatatcatccaaactgctaagttcactggatactccaatacctggaatatccagccatctcttcatatcaaagttaattacatatacacgatacctgcttccccttgcgcttactgtaaatccagtaattctatcatcgatacttatatcttttaacacacattgccatgaagtgttcttataattacatatataagttatttttttatccaatctcatttgctgcctccattacaatttcattatcaatagtcattttttctctggcagctcctattattaaacaatgagtcagaagattattgagtttgcgtgatgatccctggcaggcattgctcagtgctttaactgcctctggtaatatcaatggctgtgttcttcctgctttctttagtttttcaatgatgtatctgcctatatcatcttcattcattcctgacatttcatactgaataacgattctctgtttcagtgcttcgtgtacagctcggttgattgtatgattaagcactggagttcctgtcatgatcaaaatgacataattacttgaatcaaaattaaagttaagaagcatgatcagatcattgagaatagctgtctttaaatattgtgcttcatccaggatgatgacaggtatgatccttttttcatcaactgtacttttaatatagttttgtatatttctgaagttgtctatttttttatgcattggttcaagtcccaactgactgcacagttcacgatagaattcaatcgtcgtaagtgttgacataggcatataaacaactttataaagtccaggattcagcgattcactaaaacttttcataataaatgtcttccctgtaccacttcttccagtaaaaagtccaatgcccctgatatctttgagatagttgagtcttcctattgcttctttaaagtcatctgtatctatttctatatctggctgtcccttttcaaagggattgaattccatcccatagtatatcttgaaatctttcatagctgttcctcctgtgcaaataaaggcctttttcgttttattcttgaattatcaacctttctgacctcatatatttcgatatagctgtcattttcatatatgaaaacatgacttagatcagggacatatttaattgtgactcttgttccaatatattcctgttttgtttcatagatctttgtattgagtctaatcgttgcatcattgatgacttttctagtaactgtatgatagaatattttttccagctgctgacgatcgatcctctttatcatatgggaatcattcataaatacatttacaggcgtctgcccattcaaagcggcatgtggtgaattgtttttctgattgacatatataccaaaagctttatcgatatcatcaattgttttgaattgggagaaatctgtattgtacatccactgttcttttaccgatttgaaagctcgctccacttttcctttttgattgccatgataaactttggcgtggcttatttggatttgcagctgagcacagatgataggcagttgttcatttttataaggagaaccattatcagtaaatatccttttcggtatgccaaatttaccaatagccctttttaaaacagtctgtacattaacggcattgtcttccagaaaaaatccatagccaacgatcattcttgagcgatcgtcaatgatcatgatcagataggtccttaacttacgaccgtttttattagtgatataagaacagtaggtcgtatccaattgccacatgtcgttggcatgttccatttcaaaggcacgcatatcttcgacaggaaggcgattcagttctggccttgaagcaatgaatctcgatactgttgaaagtgaaacatcctttttcagaatatcaccatcctctattagcttcagatagacagaggtcgctgtcattctcggattgtcggtttttagtttgattattttttctttgatgcactttgtaagcttgcgagaagttcctttatctccacgtattttaggcataagtccatcaaaaccatacttgcgatacagatcgtaccagtaacgaatggtttgaaaagagaattctttagatgttccatcaggatactgaaagggagtagaagaaattctcttataatactgcaaggcagaacggtcaggataggtttcgttgagaacgggaatgatctgttcatacctgaaaagagcgatctgcatatttaaatcttctttttttacattattcatatagaatatacctcctgacataaccatataacacctatatcaggtattcaaaggaaacgttatgggaaaaagcaatcatgaataaatgatcatatttttcgtcaggatacgttgcataaacatggtatgatactctgcaaaatagctgatgatgaaatcaaaactgaggagatcacatgaagaaaagacactcaaaaaagaatcgagacgttccttgtgatattttagataaaagatgataagctttctgacaagttctattgaaaaaccagtgagtttggaaataacagaaatagaatcattggtattgcgaaaagaagtgataatcctgataatattaggattagacaggatgcggtaagggacaatgatgctgggaagaagtgcatgagtacagttgcagctttgacatttgatacgtgtaatagttaattgaacagtatcatttacatcaacctgcaaataacgagtgtaggtcgcatggttgtgaaaatgtccaacagagccacaagtgcatctgatatgggaataatttatttttttaatatcttctttataagagttttgatcatatttattgataaaagttgtttgaaatgataacatatagattgtaaaacatacgttttattttagaaaaataaaggcaggagggcgatccaatgaccctttctttttttgtatgtcagctcctttatataataataaaatagttaaaataatttgcctatcattttatcaaattattttaactatttttctatgtttattatttttgtttgactaaatagctgttattttaattaaaataattcaccgaataacaaatgatgctgggaagaagtgcatgagtacagttgcagctttgacatttgatacgtgtaatagttaattgaacagtatcatttacatcaacctgcaaataacgagtgtaggtcgcatggttgtgaaaatgtccaacagagccacaagtgcatctgatatgggaataatttatttttttaatatcttctttataagagttttgatcatatttattgataaaagttgtttgaaatgataacatatagattgtaaaacatacgttttattttagaaaaagaaaggcaggagggcgatccaatgaccctttctttttttgtatgtcagctcctttatataataataaaatagttaaaataatttgcctatcattttatcaaattattttaactatttttctatgtttattatttttatttgactaaatagctgttattttaattaaaataattcaccgaataacattatgcagaatcttccttttgtttctccctctcaaagaagaacagatgagcttaactgtcttatccttgcagtttctctctttttaagcaatgaaggtgccagtaaagtactgaaacttcttggggtcaatataagcaatgactctatcaaacgcctgactgataagatcattattgaagatgaccctgatgtcgagtctattggaatagatgatgtggcgatgagaaaaggaaaggcttatgcaactgccatatatgatatggaagatcatcatcttattgcgcttttagatggaagagataaggaaacagttgttgaatggctaaaaaatcatcaaaaaataaagattgccacacgtgacagagcaagtgcatacgcttctgcaatcagtgaagttttacctgaatgtatccagattgcagacagatttcatcttcttcaaaatttaattgacagaataaaagatatttttaaaacggaaataccggaaacagtattcataaaagatggaaaggtactggaagaggaacctcaaaaggttccagcattaaaaatcgatccaaattcaaaggaacttgaaaaatatgactatgacaacagtatgccagttgataaagaaggaaatatgattgattttgatgcggtatgttatgataaaaacgataaacaacacagacagcaggctgaaagccgtaaaaaaaacagaaaatgatcattgacattcaaaaaagatgggaggaactcgaaaaaaagaaatacacaacaatagctaaagaattttcaatatcaaatattgtagctaaaaaatatgtaaatatgagtgaagaggatattcaattgttagacagtccaaagaaatacaaacaaagaaaaacagctacagatgactatatcaatatgatctataaaatgatcctggatggaataaagccagaaataatctttagctatgtcattatgaaaggatataaaggtacgtggaagtcattggataacagaattgtatacttattaaaaaataattttagtatttctctttcaatggggtggtatattaagtataaatatccagataatatcatcatcataaaaagaaatgaaatattaaaatacataacaactaaaaatgagaaaacaaagaaaaataaaacagttgaaaaaaacattcaaataatcaaggaaagatatccaattataactgaactagaaaaaatatatgattcgttttacagcacgatcaaggaggcagatactgatcagctagataagtttattgataattatagagaatcagtattaaaaggatttatagaaggtatagaaaaagatattgccccgatcaagaacgcaatatcttatccatatagttctggatttgttgaaggaaacaacaacaaattcaaactcatcaaacgtattttatatggaagaagcaaaatagtcaatctttttaggaaatgttacataccatttttaatgaataataaagattttaagctaattgatattttagaacacaaaaacagcacaatttcttgtgctgtctaataagttcatttacccataagcgagtaagaacctggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcgctgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacttgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaatagtgaaaaaatagcctgttatatgaacagtattattgatggattgacgatagcaaaaggattaagtataataagcgctcatatagcacaataccaggcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacaacaaataaggcgttgtaatcaatcgcaactttgggcttacccttatgattgacaaacagaaaattgctccgtccgtctatcacaaatggttctgcctttgggcgttttttcataacccgttgaaatgcctgtatcgtttctctgcttaatggcacttgccttattccgctctttgttttaggcgtttcaatataatagccctgttccttgttctttaataactggtggtcgataatcacaacttcattcttgaaatcaatatcggctactgtcagtccgcacagttccgagatacgaagtcctgtttttaacaatatcagcatatcatcataatatttgtgatacacattgtccgtcttgatgaatgagagtaaggcttgttcctgttcctctgtcaatgcgactttctctttggtatcattttctaggacttcacttaatttgaaatcaaagggatttttccttacgcaatcgtcttgtatggcgatatagaatgacgcttttaacgagcgtttatggttgttaatggtattgtaggaaaagcccttgtctttcatgcgtaacgcccattctttagcgtcagagggcttgattgtatcaatgctcctagcacctaatttgtcctctttcaataaccgcatgagttgttcccgttgtttttgtgtgcttttcttcacatttgccctttgtgcgttctgtttggcatagagttggcaaagcgtcattttcttgcctgcgctgtcgataccgtcctcaatatcccgtcttatctgctgttccagttctcgaagtgagggtttttcccgttttccctttggtgtcgggtctgtgggtgtcaatctccaagcatacacatattttgtgtttccaaatgcgtctacatatttatataagtattttccgtctgttcgttggctctctccagtatgcaggatacgacctttgttatcccgtcttttttctctcatggtgtctgctcctttccttgttggaaagagccttgatatgacttgtgcttatcataacacatacaaggctcatttgcattagattgcgtccaatttatcaataacctgttcaaactgtcggcgtttaatctgtatgcggttgccattcataatgagccagccagcgtccttgttttcctctgccaatcgtcttaacttgttttctccgatacggaaatactttgacgcttcttcaatggtaagggtatatttttcccatacgggaatatcctgtgcattactcataaaacaccccctcactttcgattacatctgctatatccgtacacatctgttctacaagcatttcctgtttttcggaaaggtgggtacattcatcaatcattttcatgtagtttgagcctgtcagcctgtcgatttcctctatcatcacgattgacggcatgacctgtctttccagccattgcagagtgcgttccatattgacaggtacggggttcatttcaaaaggtaaactgtcatgggaaatgaatatctcccacaacggatagtcgggaaattgcacaaaatcagtaatgaggtaaaacaccagcccatgagggttatatgtcaataacaattcctcaactgcctgtactgcctttttatcacgcagacgaatttcaaaacggttgataatatcggtatgtttctttttcgttgcctgttccttttgtttttcatacaggcagaaatattttgtgcttgcctttgaaccgatataaagggtacttgctaaattgcggtttttcccacttaattttccactttgtacattttcatagtttttacagcgacattccgcaccgctatttttatatttttcagacaaaacgggaatatccagcagaccgcacatatcattgattgccaaatcaaaacgtcggataacaccgccacagtcaagacagcggtttaaaaatgaataccaatccctgttctgtgcctgtaagacatattccatgttgcgtgagcctgtcccttttaattccaaaaatacgcccatgtgttcatcatcagaagccatgaccttgatttccccgtaggcgtaatgctccttatagccataatacccatagtcataatggataaaataatctgctttcatgccaagcacctttcggataacttctaatgcgtcagtcgttggaaaacggacagacagataatcaacgagcagataaaaaggcttatcgcagatatagtaattcagacaacgcaggataatattttgtgtttccttgctggcgttggcttttccgttctcaaagcggttgatactatatcttgatacatgggtaagacctgcaagttctctttgtgaaagaccgcttgcaagacgtttgtttttcatttcaagtgcaaattctaaattgttcattgtatttctccaatcccacaacagccttgaaatacctgtaaaccactattcaaaagaatgtgaagttactatcttcttaaaactcctcattactccttacagctttggggttgtatggtttttgacttgtcttttgtgaaatagtgcccccctgttagataacgggggcacagacaaggctcacaagttcgccagccgacaaagcatttccgtcctttgacggcaagccgtcatggcgttgttgctgacgcacgccaacagtcctacaatgctctgtcggcaagtcctgtgtttgtcctttcaaacaagttccatttcaaccgatattcatatctacgggtttaatcagatagatattttcttttgaatgtttttgtatttcattctattgtgcttatttgattacaagaacatagtaattcttatatgcttatttgtcaatatctttttttatctttacaaatcatattaagcatgatagacttataacagcgaagatataacgagttatggagggttatgcaatgaaaataagccatttaggaaataatatacagaccataagaaaatttaggggaatgaaacaacaggaacttgcggacaaaattggtatcaatatgcagagcctttccaagattgaaagagggttgaactatcctgcttatgaaacgctggaaaagataatggaagtgctggacgttacgccgaatgaattgttgtcgggggaatggaaatatgtcaatcagtccgaaaaagaagtctgtcagtttttaagaacagaagaacgtctaaatgcagaattaaaacatggacattatgacaacttctttgacagcgaggaagaatggctggaatatgaattagaaaagttacgggaatatattaccgactacatcaatggaacaaacattgaagcgtccgacctttacccaatcaaagaatttatccagcatttgaagtttcaaaaactgttagaccgctatgatgatttatacagcatggatatgtttggggaaagcatagagggacataaatataggacaccttatcaagtggtaaaaatgataaaccctaattcaaaagaagatatggaattattacgggaagtattaaggaataaccattttgatgatgaggacgaataatctttttcctcttgcatggaagatacagcaaacaaaaagcccagtaaagagtgcaaagcaccaccaatggtggcaagctcttgacagggctttttcttttctgttatgggtaatcaagaggaaaaaagaataatacatcaaaatattttgatgtaatgtgttgacaaatcatgttgtaagccttatgataaatatatcaaaattatttgatgtgaggagtgataataatgaatgatttttctaaagacgcaaaaatttttaaggctctttgtgatacaaaaagacttacgattttagattacttaaagagcggagaaaaatgtgcgtgtgttctgattgaaaacatgaacataggacaatcggctttatcctaccacatgaaaatactttgcgactctggtattgttaatgcaagacaagagggaaaatggactcattacagcctaagtaaaagtggaagtgaatatgcgtcaaaacgattgttagaactaacaacaccaaatgctgaaaatcaatcaatttgttgcaaataaaggtcatcgaaaggtggcttttataaaactttatcacatcaaaaataattgatatgtcatgtaaaggagggactttattggaagtagtaaattcaatatggctattttttcaagaccaaatattaggtatgaaatggttgaatggcttaattggtaatgggctatcattgctagggctagacattaacagtcgtttaggtggaagtattcaattctttttatacgatgtaatcaaaatcacaatcttgttatgtttactgattttctttatatcgtatattcaaagttattttccacccgaacgaagtaaaaaaattttagggcgatttcatggtatcggtgcaaatatcatatccgcattgttaggaacagttacaccattttgctcgtgttcttctatcccgttgtttataggttttacaagtgcaggattaccgttaggagtaactttttcctttttgatttcttcgcctatggttgacttaggaagtcttgtattgctaatgagtattttcggggctaaagttgcttttgcttatgtgattgtaggcttgataatcgctgtaattggcggtactttaattgaaaaaatgcacatggaaaaatatgtggaagatttcgtgaaaaatgcaagtaatgtcgatattagttctcctactttaaccaaaaaggatagagttcaatatgcaaaagaacaagttgtaggaacattcaagaaagtatttccatacattttgattggtgtgggtatcggagcagttatccataactggatacctgaaacatggattgaaagtatcttgggcagtaataacccgtttggtgttattttagccactcttgtcggagttcctatgtatgctgatatttttggaacaattccagtagcagaagcattactttcaaagggtgcacaattaggtacaattttatcatttatgatggctgtaacaacattgagtttgccgtctttaataatgctgaaaaaggcagtaaagcctaaactattgaccctttttattgccatttgtacgtttggcattattattgtaggttatctctttaatatttttagtacattatttatttaaaaggagcgaataagaaatgaaattatttggaaagaaaaaagaaacaaaatcatgttgttgtggtggaaattgcacatcagaaacaatgcaaaatgcagaaaacaagaaacaagagcaaggcattaaaatattaggttcgggctgtgcaaaatgtatggaattggaaaaagcaactagaacagcaatatcggaacttcaattagattatgagattgaacacattacagattttgcagaaatcgctagttatggagtaatgtctacacctgcattggtgtttaatggcgaagtaatatcctatggaaaagtattgaccgtagacgaagtaaaagcattattgagcaaataataaaacaaagaaaggttggtaattcatttatgaaaaaacctaaagtagcctttgtctgtgttcataattcttgtcgcagtcaaattgcggaggcattgggcaagtatctttcttcaaatgtttttgatagttattccgcaggcacagaaacaaagccacaaatcaatcaagatgcagttcgtctaatgaaagaaatgtatcagatagatatggagaaaacacaatattctaaattgttatctgaaataccacaggtagatattgtgattacaatggggtgcaatgtgaattgtcctacaataccatgcaaatatagagaggattgggggttgaatgaccctacagggaaaaatgatgatgaatttttaaagacaatccattcaatccatgcaaaaatacttggattgacagaaaaaataaaaataatgcgttgatttcaaggagaaactaaatgaaaatattaacgaagaatattgtcataaattgttttaagcacactattaaacagtctaatatggcaattatcaacatctgaatataaggaaattttgaaggctcgtgcagactatatgttttgtgcgggcttttttcttgctttcttttttacattaccaaaaggtataggcggtattcccgtttatatatttcggcgtatgcagaaagggggtgagattatgaacacatcttctttcgagcatatcgtcagaatacagtttaatgctttgatgataactgttattaaatgcacagtaaaaagcagaaatagacagtttgcaagacgttccaagcgtgaggttttattctatgaattatcagatacgaaaaatcttgaatgtgtaactgaggataaatattcttgtgattatatttcttttgaagtcttgaatttcacaattcaaatatcaaacgagaaacttgctgttgctttatataagttatcgagtaaagagcgtgatgtaattctattacgctattttcaaagcatgagcgaccaagaaattgcagaattatatcatgtatcacgttctgctatttatcgcagaagaagtaacggattgaagaaattaaaaacattattgaaagaaaggaattgaaacaatgaaaaaagaatatggctaccctacattaaaagtaatatgtaaagcgtctgctggaaatgaaactgccataagagagattttgaagttttatgacgcttatatttgtaaattatgcttgcgtccgttttaccactctgaaagtggtaaaattactatgcaggttgatgaagaattaaaaggtcaaattcatacagaaatgatgaaagcaatcttgaaatttgaaatcagagtaaagtaatcatattacatgaatgaaaaacgggagatacacagatatttgtgctatctcccatgttgttttttgtgtcatatcaaggctcattcaatcgtggtaaattcgtggtaaaatgagtgtttttctataccttaaaatacttgaatgtatagtatttatgcggataattgaaaatgagatataaaatttaaaagaatcattacagtgattctttttttattttcttgtgagcatattatttgtttttattttttttctatgttagtatgcaattagttagttgtaaccttgagtttagaagtaaaaatgccataaaatcgggtaaaccccttgatatataaggagttcacccgatttgtttttttacttttgatgtagtgtaatttctcttttttctaatattttaataatttttttatttcatctctttttctgtattttttattgagatcaatatcaaattcttctgatatgtcttttataatgctgtcattatatataaactgatatatgttcctgtctatgtttatgcagttgtatttttttgcagtttctattattctgtctaccgaatatttataattcagtcttttttctaggagtcttatcatgacaagtgctgtaaaacatgttagaaaatgcccttctatatgttcttttgtccacacaaatgttggtcttgcttcgaaatttgttttactgactttgaaagtatcttctatttttgtcagacctctgtatatttttcttatttcgtagtcatccagttcaatttcacttgttacgatggaataatatccatcatatttttcttcttcttttatcttttcttcatctaaaaagagttctttttctgttttgatttcaccggttgttctatcgaattctatattactgatatatccagcagcaccgtatgatgttgcttttgtgtatccagctggatttttgatcatctctcttgcttttttgatcattctgtttctgtcgtttcgctgtttcatgagatatttgaatgaaaaataaaccatctgtttttgacatacattgacctttacttttcttttgccgtctcttgttgttatttagcactttatattaactagaatttatcaaattattttaactggctttttccattattttgactaattagttatgacaatcacactattttacttattcccgtcaaattacgccaactataatttcaatataaaaagatagtaattttgccttttaacagctaattactatcctcttttaatattaaactttatactgtattctctgatgaaaattcaacgttatgcctggtattgtgctatatgagcgcttattatacttaatccttttgctatcgtcaatccatcaataatactgttcatataacaggctattttttcactattccagaaaatatcatccaaactgctaagttcactggatactccaatacctggaatatccagccatctcttcatatcaaagttaattacatatacacgatacctgcttccccttgcgcttactgtaaatccagtaattctatcatcgatacttatatcttttaacacacattgccatgaagtgttcttataattacatatataagttatttttttatccaatctcatttgctgcctccattacaatttcattatcaatagtcattttttctctggcagctcctattattaaacaatgagtcagaagattattgagtttgcgtgatgatccctggcaggcattgctcagtgctttaactgcctctggtaatatcaatggctgtgttcttcctgctttctttagtttttcaatgatgtatctgcctatatcatcttcattcattcctgacatttcatactgaataacgattctctgtttcagtgcttcgtgtacagctcggttgattgtatgattaagcactggagttcctgtcatgatcaaaatgacataattacttgaatcaaaattaaagttaagaagcatgatcagatcattgagaatagctgtctttaaatattgtgcttcatccaggatgatgacaggtatgatccttttttcatcaactgtacttttaatatagttttgtatatttctgaagttgtctatttttttatgcattggttcaagtcccaactgactgcacagttcacgatagaattcaatcgtcgtaagtgttgacataggcatataaacaactttataaagtccaggattcagcgattcactaaaacttttcataataaatgtcttccctgtaccacttcttccagtaaaaagtccaatgcccctgatatctttgagatagttgagtcttcctattgcttctttaaagtcatctgtatctatttctatatctggctgtcccttttcaaagggattgaattccatcccatagtatatcttgaaatctttcatagctgttcctcctgtgcaaataaaggcctttttcgttttattcttgaattatcaacctttctgacctcatatatttcgatatagctgtcattttcatatatgaaaacatgacttagatcagggacatatttaattgtgactcttgttccaatatattcctgttttgtttcatagatctttgtattgagtctaatcgttgcatcattgatgacttttctagtaactgtatgatagaatattttttccagctgctgacgatcgatcctctttatcatatgggaatcattcataaatacatttacaggcgtctgcccattcaaagcggcatgtggtgaattgtttttctgattgacatatataccaaaagctttatcgatatcatcaattgttttgaattgggagaaatctgtattgtacatccactgttcttttaccgatttgaaagctcgctccacttttcctttttgattgccatgataaactttggcgtggcttatttggatttgcagctgagcacagatgataggcagttgttcatttttataaggagaaccattatcagtaaatatccttttcggtatgccaaatttaccaatagccctttttaaaacagtctgtacattaacggcattgtcttccagaaaaaatccatagccaacgatcattcttgagcgatcgtcaatgatcatgatcagataggtccttaacttacgaccgtttttattagtgatataagaacagtaggtcgtatccaattgccacatgtcgttggcatgttccatttcaaaggcacgcatatcttcgacaggaaggcgattcagttctggccttgaagcaatgaatctcgatactgttgaaagtgaaacatcctttttcagaatatcaccatcctctattagcttcagatagacagaggtcgctgtcattctcggattgtcggtttttagtttgattattttttctttgatgcactttgtaagcttgcgagaagttcctttatctccacgtattttaggcataagtccatcaaaaccatacttgcgatacagatcgtaccagtaacgaatggtttgaaaagagaattctttagatgttccatcaggatactgaaagggagtagaagaaattctcttataatactgcaaggcagaacggtcaggataggtttcgttgagaacgggaatgatctgttcatacctgaaaagagcgatctgcatatttaaatcttctttttttacattattcatatagaatatacctcctgacataaccatataacacctatatcaggtattcaaaggaaacgttatgggaaaaagcaatcatgaataaatgatcatatttttcgtcaggatacgttgcataaacatggtatgatactctgcaaaatagctgatgatgaaatcaaaactgaggagatcacatgaagaaaagacactcaaaaaagaatcgagacgttccttgtgatattttagataaaagatgataagctttctgacaagttctattgaaaaaccagtgagtttggaaataacagaaatagaatcattggtattgcgaaaagaagtgataatcctgataatattaggattagacaggatgcggtaagggacaatgatgctgggaagaagtgcatgagtacagttgcagctttgacatttgatacgtgtaatagttaattgaacagtatcatttacatcaacctgcaaataacgagtgtaggtcgcatggttgtgaaaatgtccaacagagccacaagtgcatctgatatgggaataatttatttttttaatatcttctttataagagttttgatcatatttattgataaaagttgtttgaaatgataacatatagattgtaaaacatacgttttattttagaaaaagaaaggcaggagggcgatccaatgaccctttctttttttgtatgtcagctcctttatataataataaaatagttaaaataatttgcctatcattttatcaaattattttaactatttttctatgtttattatttttgtttgactaaatagctgttattttaattaaaataattcaccgaataacatcttgtaattttgatttccttggaatacactcttgatttatgtgtaaaggcaatctttttattgttttcatcaataatatctgttttataccctttttcatcaagtacccactttttaaattccttgtctgctcctcttacagactgtccataaacatatccgtctctttttgaattttcatcattattgaagccggcaatataaaatatattatctgatgtattcagtcccctgtctgctacaacgatggtacgttctataccaaaatcagcttttgtttttttcagtataggtcttaatgatgttttttcggattcattgcctggaaaaatatcataggacatgggaattccactggaatccatcaaaagtcccaattcaataatagggtcgggtcttttgtttttttctggaccgcgttttctcatgcctttttcaatgatttcaccattttcatcaataatatcatcatcattgtattcaatctcgaaatagtagtttgtacagtcataatagctttttgagcagtctctttgatagaaatcttttgatttgtcccagaggagcttgaggatatcgtttttatagagataaaaatagtcaagacagtcataaacggaatctctggtaataccattatcaaaaggggcaaagaaaagatttctgttttcgaatgtcgatttctttgaagagggataaagtattcttgaaaaaacaagaagttcaagatttttattcagagaaaactggatattcagtcttttttgcttatttatgcagaaatcgttgaggccgagctgattgtagatatatttaaaaggaagatatccaacattcaggcagttataaccattatcaatataactgttaagatctatagaaagagaaaaagtagaatcagccttggcatcagctgtcatttttttagcgagattcttgaaatgctgaacaggatcctcataatttttttcgagttcatcgagaaaaccgatttttttgataacacgctgtttgacttttccatcttcgcgatagccttcaacaatagaaagaaaggaacgaccatttttaaatttagcgactttaagaaacataacgaccaacctccaagaacattataccacaaaatataacaatacacaacacaaaaagaacaaaatgttgacattaaaaaaagtcctgaatcccatgtaggataaggacttggcatagatgatagtataataactgcttcgaaactcgggagttaagtttagaagtacttataaaaattgcaaatgccttaggtataacttctgatgatatcttatctcatgaatttcaaaaagtatctaaacattctatcgataaaataaacaagaatcttgctatcttagcacaaaaaaatagtgaagatattgaattattaaatgttatcattgattttattattaataaaaatagttaaaatatgactattatttaaaagaatcattacagtgattctttttttattttcttgtgagcatattatttgtttttattttttttctatgttagtatgcaattagttagttgtaactaactaaaaaatttattaaataaaagtaataataatttaataacaggttaaaaatatttatgtagaaaaggagaaattatatgtcattaatcggaaaagaaattacagaatttgaagctcaagcctttcatgaaggtgaatttaaaacaattaaaaaagaagatttattaggaaaatggaatgttctatttttctatcctgcagattttacttttgtttgtcctactgaactcgaggatttagcaaacaaatatgaagaatttaaaaaaattaattgtgaaatttattcagtatcatgtgatacacactttgttcataaagcatggcatgatacttcaaaaacaatcaaaaaaattaattatccaatgttagctgatccaactgctaaattagctaaagatctagatgtatatatcgaagctgatggtttagcagaacgtggaagtttcattatcaatcctgaaggtaaaattgttatgtatgaagtgattgctggtaatgtaggtagaaatgcagaagagttatttagacgcgttcaagcttctcaatttgtttatgaacatggtgatgaagtttgtccagctaaatggaaacctggtgaagctacacttaaaccatcattagatttagtaggattaatttaatgaataatttttatgatgctattattgttggtggcggtcctgcgggactgtcagcagcaatatatctagctagagcaaaattttcagttttagtcattgaaaaagaaaaaattggtggacaaattacaattacttcagaagtagtaaattatcctggtgtatttaaaaccagtggtcaagaattaacagataacatgaaaaagcaggcccaaagttttggtgctgaatttatgattgcaaatgtcaaacaagttaaattggaaaatgatattaaagaaattatttgtgataaaggaacttttaaaagtgttggtgtcattctagcgacgggtagccatcctcgtaaattaggttttactggtgaaaaagaataccagggccgaggtgttgcatactgcgcaacttgtgatggtgaatttttcagcggaaaagacatttttgtaatcggtggtggttttgctgccgctgaagaagctgtctttttaactaagtatggtcgcaaagtaacaatcatcgttcgtgaagatgattttacttgtgctaaaggagttgcccaaaaagctaaggatcatccaaacattgatatccactacaatacagaaattgttgaagctagtggtgatgttagtttaaaaaaagctatttttaaaaataataagactaatgaaacatggacttatgaaactgatgatacttttggaatctttgtttttgccggttatgaaccagcaactgctttattcaaagatcaggttaaattaaatgaaacaaataatttggttgttgatcaaaatcaaaaaactaatcttgatggagtttatggagctggtgatgtatgtgtcaaagaattgcgtcaagttgttactgctgtaagtgatggagctactagtgctacagctttagaaaaatatattcctaaaattatttctaaacatggtttaaaaactaaaaagcaaacagctcatgttgaagaaacgtctgtagaaaatagtgatggttttatttccgaggaaataaaacagcagttaacacaaatttttagcaaattagaaagaaatttagtaataaaatgttctcttgataactctgcatttagtgatgaaataaaattatttatagaagaattctcatctttaagtgatcgcatatcttaccaattattagagggtgaaccagcaatggacttttatgatgaagatgataattatctaaatgtttctttccatgcagttcctggtggtcatgaatttaattcattcattattgcaatttataacacagctggtcctaaacagcctttagataaagaactcattgatacgatcaataacattaataacaaaattgatattaaagtacttgtttccctatcttgtacaatgtgtcctgatgtagttatggcaactcaaagaatcgccagtcaaaacaaaaatattacagcttcaatgtatgatttagctcattatccaaaattaaaagaacagtataatgttatgtctgttccttgtatgattataaatgataaagatgtttattttggtaaaaaagatatcaatgaaattatcgatatcattaaataaccagtcataggactgactaatggagtcaacttaagaggttggctcttttttattatgtatcttctttgatatcttattttctagattttttattgctgaagatggaagctatatggaaattcctcataatgtttatcgtatgaatgattttgttactaatgatatgtttgatgttaaaaaagtataggctaaaactggtagactttatgatgttgtcaaaagactatatagagaaatccaatttttataagtaacaggtttcatttatgaaatctgacgatgaatggacagaagtagaaagagatcaaaaatggcgaaaaagatttagattttctcctgagactatagaatcaagaaagtgtgctccactattaaaaatcaggattatcaaaaaaattgagtatcctgacagtggtagtgtcaaataagttatgaaaaaatgaaattttttcataactagaattccatagtcgattctatgtaataattcaaggcttcatcaagcaatatgttccacttacttggcatattatgtgtcttttttaaacagtcgagctgtacaggcggtttatatcctagagctgtatggttccttaaaaagttaaagtatgttgtaaacagacacatgaagtcattggcacctgcaaacgtgttgaaaccgttcttgacggcatatgaatattgaaatgttcgatttaaacgttctatgatctgtttggcaggacgatgttcctttgatactggatcatcattcgtaagaccaataacctgtgtaactttaaagaaaacacgtttgagctgaaaatattgctgagctgccttatatataggattgccatctacaacgaattcgagattttcagggatttccttgaattttcttaaaacagaatagaaagcatcgatcgcactgaaagtgttattcggtgaattattttaattaaaataacagctatttagtcaaataaaaataataaacatagaaaaatagttaaaataatttgataaaatgataggcaaattattttaactattttattattatataaaggagctgacatacaaaaaaagaaagggtcattggatggttcttactcgcttatgggtaaatgaacttattagacagcacaagaaattgtgctgtttttgtgttctaaaatatcaattagcttaaaatctttattattcattaaaaatggtatgtaacatttcctaaaaagattgactattttgcttcttccatataaaatacgtttgatgagtttgaatttgttgttgtttccttcaacaaatcccgaactatatggataagatattgcgttcttgatcggggcaatatctttttctataccttctataaatccttttaatactgattctctataattatcaataaacttatctagctgatcagtatctgcctccttgatcgtgctgtaaaacgaatcatatattttttctagttcagttataattggatatctttccttgattatttgaatgtttttttcaactgttttatttttctttgttttctcatttttagttgttatgtattttaatatttcatttctttttatgatgatgatattatctggatatttatacttaatataccaccccattgaaagagaaatactaaaattattttttaataagtatacaattctgttatccaatgacttccacgtacctttatatcctttcataatgacatagctaaagattatttctggctttattccatccaggatcattttatagatcatattgatatagtcatctgtagctgtttttctttgtttgtatttctttggactgtctaacaattgaatatcctcttcactcatatttacatattttttagctacaatatttgatattgaaaattctttagctattgttgtgtatttctttttttcgagttcctcccatcttttttgaatgtcaatgatcattttctgttttttttacggctttcagcctgctgtctgtgttgtttatcgtttttatcataacataccgcatcaaaatcaatcatatttccttctttatcaactggcatactgttgtcatagtcatatttttcaagttcctttgaatttggatcgatttttaatgctggaaccttttgaggttcctcttccagtacctttccatcttttatgaatactgtttccggtatttccgttttaaaaatatcttttattctgtcaattaaattttgaagaagatgaaatctgtctgcaatctggatacattcaggtaaaacttcactgattgcagaagcgtatgcacttgctctgtcacgtgtggcaatctttattttttgatgattttttagccattcaacaactgtttccttatctcttccatctaaaagcgcaataagatgatgatcttccatatcatatatggcagttgcataagcctttccttttctcatcgccacatcatctattccaatagactcgacatcagggtcatcttcaataatgatcttatcagtcaggcgtttgatagagtcattgcttatattgaccccaagaagtttcagtactttactggcaccttcattgcttaaaaagagagaaactgcaaggataagacagttaagctcatctgttcttctttgagagggagaaacaaaaggaagattctgcataataacctttctattgcatttgtcattagtacagtcatatttataagcaatcacatcaataaaagttgttttatttctaacaggataagcctgaatcattctatgataggtattatgtaaagaacttgtaggagaaccacacacaggacatacatcatcatgagaagtcgctttcacatatattatgattttattatctgattctttccagtcatagacaatgaagtcattaccaaagattttttcattcaaactgatttcattatatttcatatgtatcaccatccatacatatattgtatcaaaatgcccaaaaacaagaaatacaaactaaagaaaaacagcacaatttcttgtgctgtctaataagttcatttacccataagcgagtaagaacctggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccatgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaattggtcctatgtcaagatttcggactaactaaatgtaagaaaattagttagtttcctctaacatatatttgttctcatattcatttggtgataaatattcacaatgtgagtggattcttactgtattatagaatccttctaaatattcaaacaccagctgatatgcctgatgataattcattatcttaaatctgtttagccactctctttttattaatgcgtgatatgattctatacatgcattatcccatggattaccttttcttgaatagctgcacaccatatcccttgtcagctctcgatacctcctcgatgtgtaatgtattcccctgtcactttgtattactactggattggctgtttttcttctgctctttgctgtttccagacattttaatacctcatccacctccagtgttttacttaatgtccaggctattatttttcttgaatataaatccattatactggttagatatacaaatccttcatcatgtgtgtatatataagttatgtctgtacaccatgcttcatttggcgcctttggattaaaatctctttttagaatattatgtaatctgctggaaaagtcacagtcttttgttgttttagtatatggcttgatatagtgggctttaatgttgttttctttcattagtttccctacaaatctttcactaaccttatgtccttctctttgaagtatctgggttattttaggtgctccatatatttcttttgattccttgtgtatttccttgattctaacagctagtttagctcttcttattttttgattacatggttttcttttaaggtagtcataatatccagatttactgatattcaatttttcaagcatactggtaactgaagctttaggatcagcgtcagattttttcttgatctgatcatacagttcctgcttagttaattccccagtatgccaatagccttttttaggacatctaaagcatcctttgtatccttaagttctttttttagtttggcaatttctttagcttcatcactggaatagttgccactgcccctggaattaattgtaccattattatttttagcatctttaagccacttgtgaacagtactgtcagcaacaccaaagtgtttggcaatagcgaccttggattcatcagggtgctgcagtacatagtcaacaactccctgtttaaattcatctgtaaatgttggtttactcataatcatatacctctttcatttcttataattaactcatgacattgtaccacaggactgctaattcttccatttaactggtacagtttttattctagcaccaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcactgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaacagtgaaaaaatagcctgttatatgaacagtattattgatggattgacgatagcaaaaggattaagtataataagcgctcatatagcacaataccaggcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacactgaaagtatcacgtttcatgtatatcctatatgaagtgatgattttctttctgacatcacacatgaagaaaacataggcttttttgcctaaaactttcacataagtttcatcaccacattgataaggattgaggtcatgcttaaagctatccatccagggaaaaagaagatgacttgcagcctgggcataattggcaattgtctgatgagatatcttgatatcatggacttcatggagaataagagcagtttttctcaatgaaaggccgtaattgacataataagtcagggcaagccctaaaacatgcttagaattgcgtatgcgtgtcaaatcgatctttgagggctcaattttaagctgaatgctttccagtctgtctaaagaagcattgaaaacacgagtgatgtaatgaagagagaaagcagaaggagtctgtttgtaattcttcctgtcctctttggaaagctttttcagttcagctctatagtgtgaacatttgggactcatgcatttataaatgtcaaaactgcttctggatttgataagagtcagttttttaccacagaaaggacattttctaacaacctgctgagaataggatttttcagtagagaaggtcttttcgcatactttacatttaatttgagatttcttttgaccattattaaaagaaaggtattcatgagtggcaccgcaatgagggcagacagtacctttagcaggataatctttacctttatgtctaaaaaccggctttaaaggtttgttgtgtttagcttcataagcagccctggcttcatcgaaagagacaggaagatgttcaggttcgataacaggtaaaggatgaaccttgaatcttctgtaggcatcactaaccggattaggattaggatcgttaggaaggaactgaagaagaaagcattcaaatttatataaaagtttacgaaagatatttaataaagaaataataaatgatataatcttaaccatggtaattacactcctttgtgattgttgtggtgacttcattataggatgtagttaccatttttgtatagaggaaatggttaagtttatagattaatttcgggggaaattaatcagaatatataaaaaaccaaggtagaatgaggttttacagttaaaaagacatataaaaaactaactgttttttgacactaccctgacagtaagggaaaataacatatggaaattttactaatcttgatgataaagaattcatcgcttcagaagtcatcgcactatatgttatacgctaggacaacaaggtgtcctacaagactttaaaaacaacctgaaaaatagaaagacatataagtgaaaatagtgatgttgctcaaaacgatatatatgcaaaagtcttgtttcataatattttaggaatcataaaaaagagatgacctattaaataatagaaagatagataaaaagtatgttatcaacataatacaactgtatgaaatgatctatgacaaaaaaagttaaaaaagaaaatagtcagtataaagaagttaatagacaaaacaaaagtgcctgttcgcccaaacagacactatcaacgatggtaacgtatcttaataacaccaccaagttaccgttttagacttgatgaacgcaataattcaaacgatataaatccatgcttatgactgtgtgaatatatatttattatattacaatttcatagaaaaacgtaaaaataagataagatattttgcatttttgattactagaaatactaaattatctgtatatttcataatagatatttcacaaaaaataaaaagagtcagcataagcagtatctcttatattgactccattaaccagtcttatgaccggctattttactaaataatttcctaatggtgttttcatgtgttcaacgacataaccactgccaccacgattttttacatcttcaaccattgttgttattaaaataggattatcgctattagttgtagtaatcgtaaaccaccctaactctgttcctgttgtatcactttgcgatgccttgatttctgctgtccctgttttccctgctaattcaatattttcatgataaatagcatgcccagttccattaggatcactgatgaccccaattaaagcatccttgatcgtattagctgttgcttttgtaaatgcagattcgatccatggtttttctggcttttcatccataattaaatatggctgattaattgttccttcattaataaaagcactataaattgatgctaattgaacaggattcattaataattcaccttgtccataaccactgtcagctaactgctgatcattaaactcactatctttattttgatactgtgatttatttaatgctaattcaaaaggaattttatcacctatttttaatttatcataccctgcaattaatttatctttaccaatttcaactgcagttctcgcaaaataaacattatcagaataaataattgcattctttaaattattaggagtaggcgcatgtaaagtagttacataataattaccccagctagaatctttttgccatttatctttagcccctaaatctttatcaggatcaattgcttcagcatctaaaccaatagctccagtaattggtttcatacttgaaccaggtacataagttgttcgaaaccgattcgttagaggtttatttacatcattatttaaagcatcccattcatcactactaaatcctaaaataaaatcattgcttgaaaatgatggggttgaaactagagctaagatttcaccagtttcaggattcattgctactgaagcacttttatcattttgatattcattatatagatccttttgtaaatcaacatcaattgttaatttgatatcttttccatttttaacttccttacttgcaatagtttttatttctttaccatctttatcaacaataacgatttttttaccatcactaccttttaaatcactttcataagcagcttcaattccacttcgtccaattaatgaagtttcactatatccttcaccttcatgcttctctagatcatcagcattaacttgttgtaaataaccagtcaaatgagaagtaatttctccataaggataacaacgtacataagccgtattaagttttactccttttatcgttaataactgactagctaaagctcttccggcatcatctttagctatttcttttaatggtacaaaagaatcatctttgatccatgaagcgctcataattttttgaatactatctactgacatatttaaaagattccctatggcctgataatcactttcaccatttaatttacccggtactaaacctacagaatatgcttcaccaatagttgctagttctttatcattacgatccaagattttcccacgactcgcttcatcagttaaaactctaactttattttcttcttcaattccatcaaataacattttttcattaaagacaatttcaccatcttgcaccgcaattttattatcatagcttacttttcctgcaacagtatccattgataaagtataattaactttcccatcttcaacttcattaattttaactttaatatttttagcttcaataccgtcatagatgttttcatatcgactttcaaatacatcttgtgaggtttgtgacaaagaaccttttgttaacatcgcatacatttttttataatcttttttggctaaatatgcataatagtcttcgactaacgcgcctgcatcttcttttttatttagaagaaagaatactaatccaataataattaaaatactaattactccgataaatataactttcttctttctttctgctaaattcatttttctccctctttctctataccttaaaattatgcatatatattctagcacattttatccttaactatatagtataaatataattaaattagtaaaaaatattatagtaatttaaaaatttaattttctatgatttattgatgatcaaatgtaatttatttatattacatatgtcataaacctttttttaaatatttacaattatttaatcaaatgctatactaataaaaaattttattttgttgtaatttggattttgtgcatataatatattcgattatagaaaggggtaaaatgatatgaagaaaattgtattattatgcgatatgtttcatgatatgactattaccaatgattttttagtagacaagatgaaagaaacttccaaaaaagattctattgaatgtgaaatttatgcctatcctatccaaaatatttatgaaatagccaaagatgctgatattatttttcttagtccttttacttattttaaatcccatatgattgaaaaattggttgattgtccagtggaaaaaattggtatgggggcatatgcaaatgctgatgctaaatacgtacttgatcgtgcttttgcaagaatggctgaacattgtgttatttaaaaagacctattcaaggtcttttttattattttatgaatatttttaaattaaaaaatatgcttacaccaaaagcgtaaaacgttattattgcttgaatctggttgatgttattttagtacgataattatcataatatatttttaaaaacccctcagcaaatcatttgttaaagcaatgcttaatattaattctattttatatctagctgtaattgtctatccttatttgaagcaactatccgttcagtaactttatcatcattttttaaattccctatcagcatcaagctgtcttcatcatgctgttttatattttgattgactatcggatgattacaggcataacaatatgtacagccatggctacaacagctatacgctcctatgtcaatactcgctaaacaagaacaattagctctgttttgatttggtttaatttttaaagaataaccaattaatttttcaatataggtcttatctatacagctgcccttagctattccatattgttctaagtggtatttttcactgcaggtttggatacgtaaaccatatttagctgcaattacacctaaatgtttagctaaataataaacttcatcatcttttaattcattaaacttaccaataatatttttataaatatctagaaaactaataataactgtatttgtatatagatgtaataactgacacatcttttcaaacattattaaatggaattctttattatagtgcttgtttaataaaattggatcatagcgccaaattattttatctttgcctattttattacttaaactaataaaagttttgataatttctaatttaggacgtaatcctggttcaatatcataatcataaggcgtaattgtaatcataaaataatatttatatcctaattgatcgattattttaaggtatggcataatattttggggatctttagtacaaaaagcaatacaatcaactacatctttactaatttttatttgacttacctgctgatgatgataaggatttctaactaatacataccctgcttttaaacggttaacaaaccactgaggatataatgcacatatatcagttcttccggaaacttgtagaatcattatttctctccaacgataataacatttctttcattttaagacccccggcatacccaactagcttattattgcttccaattacacgatgacatggtattatgatcatgattcgattatgattattggcattgcctacagcacgatatgccttaggattattaattgctttagctatttctttataacttcttgtttgtccatagggaatcttttgtaattcctgccacacttttatttgaaatggcgtaccttcataatctaatggtaaatcaaacactgttcgtttgccttgaaaatattcatttagctgtgtagcagctttttttatcagtactgtttcttcttcaatataatcgtaaattttatttgttgtaactgcatatatcttattatttctttcaataatatatatatttagtaacattttatattgatatccttttaacatttgcatcacctgttccattctaacataatattttttaaatattaactattaacttatatcatttaaaaaatattcatgatatactttaaattcgaggtggttttatgaatgaacaaaaacttattaatttgattggagaaattggaagacttttattaaaacatggtgctgagatctaccgtgttgaagagtcactacttagaatgtgtaaaagttataattatgaaaacgttgaagtatttgctttaccatcttattttacattaacaatcgaaatgcatgataatcatacttatacattatctaaacggacccaacaaaatcgcgttaatttagatatgatctatgaacttaataatcttgttcgttatgtttgtgataaacatcctgattatgattgtcttaaaaataaattagatagtattaaaaatatgcgtttaaatatgcctttaatatttttaggctatggattaggaacaggatttttcactactttttttggtggtcatctaaacgaaacgatcgttgcaatgtttattggtttcattttatacttttttatttggttaatggaaatattggaaatcaataatcttgtatctacgcttttatccagtattgttttatcttctttagccatttttagttataaactgaacttgatcaataatttgcagtctaccatcattggctgtttgatgatcttgactcctggagtagcaattacaaacagtttgcgtgatattatgggcggtgattatatttcaggaatggctcgtatgcttgaggcgttattaacagcaacctttattgccgttggggttggtattatgatgctcgttttaggaggttagtatgcaaggattgattgaatgtttaagtgcttttattgccagtattggattttcttttatttttagaattcatcataatttgcgctttgctattattagttccttaggtggtactttaggatggtttgtttatctaaatactggtgctttacataatgaaataatgagttattttattgctatggtagtagttagtttgtatgctgaaattgcagcgagaatatataaagcgccagccacgatttttttaattattggctgtttccccttagttcctggaaaaggcatttatcaaacaatgctttattgtactcaaggtaaaaatattctttttttagacagctttattcatacgattgctatttctgctagtttagcgctcgcaattatgatcgtatcgacaatctttaaagttattaaaaaattatctgtttctaaaagataataattgttattataatttgtaaaagtaggtgaatttatgaaaattttgggattaatagttgaatataatcctttccatcatggtcatctttatcatttaaataaagctaaagaaatgatagatcctgattttacaattgttgtaatgtcaggacattttgtccagcgcggtgaaccagctattagtgataaatggactagagctaatgttgcaattaaaaatggtgtcgaccttgtaattgaattgccttttgtctacagtgttcaaagtgctgattattttgctcatggagcaattgaattacttgctaaaatgaatgttacagatattgtttttggcagtgaaaatggtgatataaatatttttacagatattgcttatactattaaaagaaacaaaagccaatatgatcatttagttaaacaacagatggatcttggtttgcgttatcctgatgcttgtaatcaggctttatcaatattaatgaataaaacgataactacacctaatgatttattaggtttagcttatgtaaaagaagttattggtcatgattatccaattacattacattgtattaaaagaaccaatgattttcatagtttagaaattgaaacaataagttctgcaagtgctattcggcatgctttaaaaaataaaattgatattgttgatcaattttgtaattataatgattatcaagaattttatttctttgaagatttttttccatttttacgttataaacttttaacaacaaatagtagtcaacttaaaaaaattcatttagttgatgaaggaatcgaaaatttgcttaaagataaaatagtgacctgtaaaaacatggaagaattggttttaagcttaacttctaaacgctatacccgttctagaattcaacggatgttgattcatattttaatgaataatactaaagatgaaattataaaagctatgaatttagattatgttagaatcttaaagatgagtaataacggtcaagcttatttaaataaaataaaaaagagcagtgaatataaaatagtaactaatttttctagtcactatcatcctgctcttgagattgaatttaaagctactaaattattatcatgtttatctaaaaatcctcgtaatttaattatgcttgaatataagagtattccaaagacctaaacggtctttttatttacgaaaagatgcaaaaaaacctttcttttcataaggaactttttctatcgaaacaactttatatccagtagcatcaataactttccttagttcattttcatcaatatcgtctacagtaataatctcagttttatttttgctatgtgaggaagtaactttttttatggtaaaagactttcttattgcatcgttaatatgagtctcacacattccgcacatcatgccgtcaatctttaatataattttttgcactataatcaccctttcgaaataattttaaacatctcatttatccttgtcaaatattatatatcttttgatttcagaaaatcgaaatactgtttatttttagtaattatcctgtgtcgtttttttatataacaccaaacaaaaacagacataatttgtctgttttttatgagtatttaaaactctatatagaatatgaactttacatttcacaagttagaaaatccaaattattttaatttatcaaattatcataactatttatccgtaatcaatttgattttcgtattttttttgaatctctttatgtaacttttcaactatttcattatcttcagcatttttcattttcaatttagtaccattgatttcagaatttgttaatggaactttaccaattgtaacggcaagaggtatgtaataaccttcatctgctaatctaagatataatatatatttatttccttttaacatattagtatatcctgcaatatgtaatatttgattatattttttatcatatgcctgattttcaaatatcatgatttcttttcttgattcatttactttattatttatgatttcatcaatttgaaaagatgaatatgtataagcaatttgataaacatcattttcatcatatataacatctgattctaattccttgacttttgtcccaataactattaagtcgctagcattttcaagctcttcaactgattcgtatgaatcagttttagcactaacaaacacatcttctacttcttttgaatcagctgtatttttttcattgttattgcagccagaaagcggtaataaaatcattagtgctagagtactaagtaaaattttagttttcatcataaccttacattcctttccgcctgcgtctccaaggcacacatagtcatgaataaagtcttgtttgtgcaggcattttattttatatttttactgaaggagtcttacactacaaagcacggggaggtgagttgtagatttctgcaactcgttcagttcaaaacagtatcataaccagtgcagggctgaacttttcaagcacacatgagtatgtcttttgagtctgtagattaatcattgacttgagttaatcttttagtgttgttcagtcagtcactgagctccttctctatattctgaaaggagctttttatttatggaaatcgtttaccctagagcctgtggcgttgatgtgcataagtctttcattgttgctgttatctgcatctctgaatccgtcaaacccaggtatattaaaaaaagattctcaaccttcaataaccaactcattcagtttagacaatggcttatcgataacaactgtcaaaatgtatgcatggaatccactggtaaatactatgtccctgtatacaatgcattggaggaccacatctccaatgtcgttgttgccaatcctaaatgggtcaaggctatcaaaggtgagaaagatgacaacaaggatgccaaatggatcgctgatctctttaaattcggtatcgtcagatctagctatatccctgaaaagaatatccgtatcctcagggaatttactcgctatcagttcaagcttgtcaatatccgttcttctgagaagaatcgtttccaaaatgccctgactgttggaaactgtaagattgatcttgttttttctgatgtctttggtaaatccgcttcctctattgtcgatactattttatcagatgaaccctataccagtgaagacattctttctaaagttcatggcagatgtaaatcttctgatgaagatattctcagtgctgttgaaggcactgatttgaatcattatcagaagtcaagaatcagaatcgttcagaaacatatggaatatgttgattctcttcttgatgagattcagcatcatattaatataatggtctctgcctatgaaaactatatccagcttcttatgactattccaggtgtcagtagaaaatctgcaattatcatcatttcagaactgggtattgatgtatcacagtggtccagtcatcgtaagcttgccgcatgggctggactcgcacctggctgtaacgagtctgctggtaaaaagaaatcagttaagatttccaaggcaggtgtttatatcaaaccatgccttgtacaggttgcacacgctgctgtcaaagacaaaaattgtgattactatgcagacaaattcagcaggatttcaaaacgtcgtggcaaaaagcgtgccatcatagctattgccagaaaaatacttgtagccatctatcacattcttaaaacaggtgaggttttcaacccatctgatatggcagacgtagaaacaacaaaacaacagcgtatcgaatacatcaaaaacaatttaagaaatgctttcaatcagctcagccgcactggtttgagtgatgaagaaattctacaattcattatcaagaaatctagcaactcacctcagacagaatagccttccatttggggaaaggggctttatgcacttttttaggtaaaacattattttccgttcttattttttattcagattaactatcccacctttttataatttatatttagccctaattcctaaaatatagataagctttattattaaaaccaagggctctcattaccgatactgatttatttattatttgagtatgatctaaagtcccacttcatgtacgacagtttctctttgccaagcaaggcttgttttaataaatgcactgtaatatacaatactaaatttaccagtacttttaaaagtcgtaacaccatatgttccgttatcttgatcaacaacactactaactatattagaagacaaaccgttattaaaggtagcaaactttattcctgtactagtccatttagaataataacttattgcagaatatctagatgtattagaggtattatatatggtaatattttgggaattaatgattcctgttttccaatactgataagcatcaatatttataatgttaaataaaaagattgatattatgattgatattacaaagcattttctattttacctttctcaatattatgaaataaatacgtaattacttttcaattccttttttcgtatataacttatttcttgcttaattctaataaatgttatactgattatcgaaatttttatcttttatatatttctttatcaatcaaattatatcaatgaaatcaactattttaaaatgttattataaacaattcctccttaaaaaacacctaattatcctatgtctaataatatcctttttcaccataaattcatatgatataatgaaatgttagttttaaatatagaatactataactccatcatatagtcgttttatctattttgataaaatataaaaagaactatcataatcgacagttcttaaaatgaatatttaaagagtaactaaatatttcttgataaatcttctaacctcttaatactgctccaaattctttttttacagcctcaagaattttttccattacagcattaactgttgcttcttccaatgttccttttggatcttggaaaattaagttgattgctacagattttttaccagtttcaacatgttctccagcataaacatcaaaaatctttgtttctttaactaactgtttactagcttgaacgatcttacggcaaacatcataagttaaaatatcttcatccataactaatgcaatatcacgacttactgatggatacattggaatatctgtaaatttaactttacttgtctttaaatttaagatactagttaaatttaattcagcaacatatacatcttttacatcatatttcttttccatcaaaggatgaatatttccaacaacacctactacttcttttcctatcatgatataagcagttctaccaggatgatagcatttatcatcttgacttgcacgaactaatttataacgtgattcttcgatccctaaatttttaaagatagtttcaacaaaaccttttactagataatagtctgctttatatgaaatttgtttaaatggtaaaccattatattcaccacagcaggcaatcgctagattttgtaactcagtatctttagaatatgtcgttgataattcaaaaatatttacatctttaatattatgagactggttgtaattaattacttgtaatagtgaaccaatcactgattttcttgttacacttctttcttctcccagtggcattgccaatttaacggtctcatttgtatggaaaatattaaaatcatctaccattgttggtgaagttaatgaataagtaagagtttcgtgtaatccttgatcctttaataaattacgaatcatatatttttttgcctgcacatcagttcttttaccaactgtcattgacatttctggtaaagttgatggaatcttatcatatccatacattcgggcaacttcttcaatcaaatcagcagccatcgtaatatcattacgataagttggaactttgacattaaattcttcatcatcaagagtaaattcaaaatttagtgaactaaagatatctttgatttcatctgttgttatcttagttcctaataatccattaacttttgttgttgttacttttacataacgtgttgcaatttgaagatcagttgtaacacttttataaacttcttttgcatcagctaattctactaatagattagcacatctttctaaaatatttaatgaattggctgtgtttaaagcacctttaatataatgctgtgatgcatctgtcaataaatttaaacgtcgtgctgtttctcttaaagcggcaccatcaaatgtagcaacttcgataactatattagttgtattttcgtctattttggtactatttgaacccatgactccggcaacacatccaataccatcatctgtagaaacaatgacatcggttggttcaattttatactcttcaccatctagcatcgtttctttacagttaaatccagttttaattacaaattcttttttattcaatttatcgtaatcatacatatgaatcggttgtcccgtttccaacattacatagttagaaatatcaacaatgttattgattggtttgataccgcttgccatcaatgcattttttaaccattttggtgattctttcgtagttactcctttaactaatttagccccaaagaatgaacatagttctgtctcgattttaacactgataccactaccatcaatacctgaaggtgtaactgctggtaaattaacttcacgtcctaacaaagctgcaacttcataagcaaaagatgttaatgccatacaatctgaacgatttggtgttaaaccaacttctaaaatcgtatcttttaaaccaagatattctaatggatcttcaccaattggcgcatcatcatctaatacatgaattccttctttatcctctggtttaagtaatcgctgatctaaaccaagttcagcaattgaacaaatcatcccattagattcttgacctctaattttactttccttaatgacaaaaccgccacccaaatcacaacctggattagcaactataactttttgattagctgcaacatttggagctccacaaacaatttgtttcacttcacctggtcttacttctacttgacaaatattgagatgatcactatctggatgtggtatgcactctaatacaagaccaattgtcatattattaccattagctaaattatgcattccttcaacttctaaaccaattgaagtaatcttatcagctaattcttttggatcttgatcatcaacttttacatatttatttaaaacatttaaactaatatccattcttctactcctttctaccaaattgacttaaaaatctaatatcgtcattatagaaattacggatattatcaattccatatttaagcattgctacacgttcaattccaattccaaatgcaaaaccttgatatacttttgaatcaaaaccacacatttcaagtaccttaggattaaccattcccgcacctagaatttcaatccaacctgtatgtttacacattgaacaacctttaccattacaattatggcatgaaatatcaacttctactgatggttcagtaaatggaaaatatgaaggacgcaaacgaacttcgcgtttttccccaaaaaacttacgagcaaatacttctaatgttccttttaaatcagccatagtaatatttttatctacaactaaaccttcacattgcataaattggtgagaatgagtagcatcatcatcatcacggcgataagtcttacctggacaaataactttaattggccctttacctttagctgccaacatagtatgtgcctgaactggtgatgtatgtgtacgcattaaaatactttcatcaatataaaaagtatcttgcatatcacgtgcagggtgtccctttggtaaattcattaattcaaaattgaagtaatcactttctacttcaggtccttctgcaatttgataacccatacctaaaaataaatcttctaactcggcaacgattgctgataaaggatgtaaagatccttgatctaatttataactaggtaaagtgatatcaattttttctttattgatcttatctaaaattgactgttgctctaagatatcttttttatcttcaacagccttcgataattcctgtttaactaaatttgaagtttgaccaaataattttctttcttcaggggccatatctttcatcgatttcatcgcttcttgaatcggtcctttttttccaaggtataagacacggatctcatttaattcttttaaagatgaacagttatccaatttagccaacgcttcttctttaatttttaataattttgtttccatatttcctcctaaaaatataaaaaatcgttccaataggaacgattatctcgcggtaccatcctaattcataatcctaagattatgcccttaattaactgtaacgtagtttaaacggcgaggattagtcgcactccaaggtgaattcaatagttctattgttagaagaatttcaccaaatatcttcctctctaaaacaactttcctacctactagtccttatcatcgtgttgttatacctaattattataacgtgtttgatctcttttgacaatagaatttatttatatttaaaataaaaaaagaaccggcagcttgctattttcgcaccgcagtactatcttcgccgttatgatgcttaacttctgtgttcggtatgggtacaggtgtgtccatcatgctatcgctaccagatctcttctctttaagcaattcctttcgagaatcactcaaaaccggataatagttccttccatttgctcgtctccaaccttctctttaggttaagtcctcgacctattagtatcagtccgcttaacatgtcgccatgcttacactcctgacctatctaccttatcgtctttaaggggtcttactcacttgcgttttgggaagtctcatcttgaagtgggtttcacacttagatgccttcagcgtttatcccttccatatttagctacccagctgtgccactggcgtgacaactggtgcaccattgatatgtccatcccggtcctctcgtactgaggacagatcttctcaaacttcctacgcccacgacagatagggaccgaactgtctcacgacgttctgaacccagctcgcgtaccgctttaatgggcgaacagcccaacccttggaaccgacttcagctccaggatgcgatgagccgacatcgaggtgccaaacctccccgtcgatgtgaactcttgggggagatcagcctgttatccccagggtagcttttatccgttgagcgacggcctttccattcagcaccgccggatcactaagcccgactttcgtccctgctcgacttgttggtctcgcagtcaaacacccttttgcctttgcactctgcgcttgatttccatccaagctgagggtatctttgggcgcctccgttactctttgggaggcgaccgccccagtcaaactgcccacctgacactgtcccgtcaccagtttatggcatccggttagaactccaatacacgaagagtagtatcccaacagcgactcctcacacactggcgtgcatgtctcttcgtctcctacctatcctgtacatcctgcatcaaagtccaatatcaagctgcagtaaagctccatggggtctttccgtctagtcgcgggtaacctgcatcttcacaggtactaagacttcaccgagtctacagctgagacagcgcccaaatcgttacgcctttcgtgcgggtcagaacttacctgacaaggaatttcgctaccttaggaccgttatagttacggccgccgtttactggggcttcaattcagtgcttcgcttgcgctgacacatcctcttaaccttccagcaccgggcaggcgtcaccccatatacgtcgtctttcgacttagcatagagctgtgtttttggtaaacagtcgcttgggccgtttcactgcggctcatatctctatgagcactccttctccctaagttacggagtcattttgcagagttccttagctatagttctctcgctcaccttaggattctctcctcacccatgtgtgtccattttcggtacgggttactgtatgattagcactagaagcttttcttggaagcttgcttcacgctcttctgtactcgccttagctttccatccgcttcacgccttcgcctttcgacaaccggatttgcctagctgtcagctacctcgcttgcacctgcttttccagctccaggatgcgctagcctgctccgtcactccttcattcataccgtaagtacaggaatctctacctgttgtccatcgactacgcctctcggcctcgccttaggtcccgacttacccagagcggacgaaccttcctctggaaaccttgggttttcggtgcgcgggattctcacccgcgttccgctactcacaccggcattctctcttctatacgctccactgctccttccggtacagcttctccgcctatagaacgctcccctaccacttacatctctgtaaatccatagcttcggtaatatacttagccccggtaaattatcggcgcagagtcattcgactagtgagctgttacgcactctttaaaggatggctgcttctgagccaacctcctagttgtctggacatctccacatccttttccacttagtatatattttgggaccttagctgatggtctgggctgtttcccttttgacagtggaccttatcacccgctgtctgactgccgagcctgtctctgtgacattcggagtttgattatattcagtaccccgggatggggccatcacatattcagtgctctaccttcacttgacctctctcgacgctagccctaaagctatttcggggagaaccagctatctccgagttcgattggaatttcacccctagccacaactcatccgccaacgtttcaacgggggtcggttcggtcctccatcgggttctaccccaacttcaacctggtcatggctagatcactcggtttcgggtctacgacatgcaactttcgccctcttaagactcgctttcgcttcggctccgcatatcctgcttaacctcgctccatatcgtaactcgccggttcattctacaaaaggcacgctatcaccctttaacgggctctaacttcttgtaagcatatggtttcaggttctctttcactcccctcccggggttcttttcacctttccctcacggtactggttcactatcggtcacagagtagtatttagccttgccagatggtcctggctgattccgacaggattcctcgtgtcccgccgtactcaggtgctgtctcaagcttcctcactatttcgactacggggctctcaccctgtttcgccggacttcccattccgttcgtctataatgtcttcttgctctttctcgacagtccttcaaccccgatccttggatcggtttgggctcctcccctttcgctcgccactacttagggaatcatttctttattttctcttccttcaggtacttagatgtttcagttccctgagtctcacctctctgaagctattttttcacttcaggatacccggtctctactccgggtgggttcccccattcggatatcgacggctcttcgcatgcttactgcttaccgtcgcatttcgctgtttgctgcgtccttcttcgcctctctgtgcctaggcatccgccatacgctctttcttactttacctattggtgttcttgatcactttactatttactttcgtctcttcagtgattcttttcttagttttcgacttctctagaaagacctcaataatcttcttatctcgatctcttcttttctatcgcaaatttcttctattatccagttttcaatgatctcttttaagcaatactcctcctgagcatcactcaaaactaaacagtattaatgaaacttcacttctcttctttctccttagaaaggaggtgatccatccccacgttcccgtagggataccttgttacgacttcaccccaatcatcaatcccaccttagacagctccctccttgcggttaggccaccggcttcgggtgttatcaactctcatggtgtgacgggcggtgtgtacaaggcccgagaacgtattcaccgcgacatgctgattcgcgattactagcgattccaacttcatgtagtcgagttgcagactacaatccgaactgagaatggttttctgggtttcgctccacctcgcggcttcgcttccctctgctccatccattgtagcacgtgtgtagcccaggtcataaggggcatgatgatttgacgtcatccccgccttcctccagcttgtcactggcagtctcgctagagtccccaacttaatgatggtaactaacgataagggttgcgctcgttgcgggacttaacccaacatctcacgacacgagctgacgacaaccatgcaccacctgtatcccatatatctatctctccatctctggagcctttatgagtatgtcaagacctggtaaggttcttcgcgttgcttcgaattaaaccacatgctccaccgcttgtgcgggcccccgtcaattcctttgagtttcattcttgcgaacgtactactcaggcggagtacttactgcgttaactgcagcactgagatttgactcccaacacttagtactcatcgtttacggcgtggactactagggtatctaatcctatttgctccccacgctttcgggactgagcgtcagttgcaggccagatcgtcgccttcgccactggtgttcctccatatatctacgcatttcaccgctacacatggaattccacgatcctctcctgcactctagctgcccggtttctatggcttactgaagttaagcttcagtctttcaccacagacccttgctgccgcctgctccctctttacgcccaataattccggataacgcttgccacctacgtattaccgcggctgctggcacgtagttagccgtggcttcctcataaagtaccgtcactcggataccattccctgtatccgcctttcttcctttataacagaagtttacagtccgaagaccttcctccttcacgcggcgttgctcggtcagggttccccccattgccgaaaattccctactgctgcctcccgtaggagtctgggccgtgtctcagtcccagtgtggccggtcaccctctcaggtcggctacgcatcgtcgccttggtgagccgttacctcaccaactagctaatgcgccataagtccatcctctaccagtgccttggcacttttaataaacttaccatgcggtatctttacctatgcggtcttagctatcgtttccaatagttatccccctgtaaagggcaggttacttatgtattactcacccgttcgccactcgggcattgctgcccgcgttcgacttgcatgtattaggcacgccgccagcgttcatcctgagccaggatcaaactctccattgtctctttatctttacaatctttcgtttgtttagctcttctttttctcttctatccgtttccggatccttctttgacgtgtgtttcttaattctgtttagttttcaatgatctctccggcttctttcgccgactcgattatcttacactcttttctctttttagtcaatcttttttttacttttttttctttttcttcgggttactttatcccttctcttgagtgcctccttaatttaccatatctctccctctttgtaaataccttttttcctcttttttctttttttatttgcatagtataaaaaaattaaaatctaagaattaaattatagctgatatctacttatatatgaaaaaagttcatagaaatcatattatatcgttacaaactttataaaaagatttctataaacaacttatatttttttcttctaataatcaaatttaattctataataccgtttatcaattttatacagtttggcatttttatttaaagtaatacattataatacttcccgctactgctgcatttaatgattcaatagtttttataggaatatatcctatttgatcacatttttctaaaatttctttatttatcccattaccttcatttcctataacaaatgccattttcttacaagcatcaatcttgtttatatctttaccattttctaaagcactgccaacaacagtgacgtcattggcttgtaatttagaaataattgtctttaaatcaccataaatacagctaatatgaaaattagcaccctgcatggagcgcagtaatttatcattatataaatcaacgcatcgatcagataaaataacttgatcaaaagaaaatgctaatgctgttctaattaaagtaccaatatttcctggatcctgcaaatcatctaaaatcaaataacgcttaccatccattaacttttcttctttttttattatacattttgccattattgattgtggtgatttagtaaaagccaatttcgccataatttcatcactaacttcaagaaccggtaaatcactactgattgctttagttgaaattagtaattcaacctgtttcgctttcaatgcttcttcaactaaatgctctccttctatcaaataataacctgtttcatcacgatatttctttttctttaatttcattaatgctttaattgtattattagtacttgaagttatcatattcctatctcctttaatcttttttctcttattttataatctgataaacgtttttcaatttcttgataaaataattttgaatgattaggctggatgaagtgacataattcatgaatgatcacataatcaattaaacttttatctaaatgtactaaagctaaattaaaagatactttattttgctttgaaaaacaagcgccccagcgtgatttgtatttttttatttcaatttcaggcattgttaaatcaaaccacgtatttaaataataacagatttgttttactaaataatcatataaaatatttttcaattcatttttaattatttcttgaattttatgatgataaacataaattttatcttcatgaattgctgctttatacatattcacatcttttaaaataatttgataccggtaattaaaaatatacacatagccattatcgatataattaaattttgaaacataattattagtttgtttcaaaataatatctcgatgatcaagtatcaatttttcaatcatttcaattggaaaatttgatggcgcattaactaccagcttaccagaaataattttcaaataacaatttttaattttttttatatttaattgatattcaacaacttgattgttaatttctatttgctttatttccataacttcctcgtataaaaaataatatttctcccataataatttaggagtgataatatggatattcgtaatgcattattaactaaattacataacagttcttttaatgaattaagagaaattatcaatgaaggtatagcttctaaggaagaaacgattcttccaggattaggagtattattcgaaaaatattataattctttaaataatactcagaaagatgaaatgataaattctttatgtaatttattgaaatagactcattaaatgagtctatttttacgatatttgaactcttcttttaaagatctcaataacatgaataatactaataaaataaaattgaccctaaacaactgattaaattgaactactaataaaataactaatattatcaatggtaaaagagttccataagcaattacttctttaccatttattacaactttagcatgttctttattttcttttctaaacgtatcaataataattttatacatttcaaataataaatagtttaatatccataacagcaagaaataaactgtagtataaaaattatcagaaaaaatcttaataacagctctagtactagtcatattaaaataattcataaaatcatatacaaatgaacatatcgtaataataaatgttgcaactgcatttcgcatcaaataaaatacaataaaatctttttttattttatccataataatcacctacttgacgagttattaaatcaattgaaaaagcaaatttatcattatcattactaaaaataattacaacacttaattctttatttttaaaattctcttcttctaaataataagatccataatcattggagttaattaaatctttactatttccactaatttttttaaaaacaacataattatcattatcatctttatctttcttaggatcttttaaataacgatattctaaagatactttaggatatttttttataatatcttcatcgtttgtttttaaacttcccagccgcatcattttatttgaaatactggcattttcaattcgatattctttattagaaccctctaattgttccacaggggtaatttctaaatctaattcactgacaacttcatcatttactttcactgttaaattagctttttcaacatcactcaatttgattttattatccttaacctctttttcaattacataacttaaattatcattagaataattatttaaattaacttcatactcatatttttctttaccattttttaataccacttcaacattagcaatagccccttgttcaactaaatcattatttttaaaaattacctttccatccccaatagaaaaagttttttcattacgatatgcttcaatattctcaactttcaaatcatcattttcaccatttaacatataatcgtaataaactacttctccatatgtttgaaaaataaaattatcatacatataaaataatgttattgagactatcaaggtaaatataactgtcatcaataaattctgcttgttttttttactcatatttcatcacctgtagtatattatatcttattttgatttatatagaaagcaaaacagttacttacaaaacgacaatattcataatgatatcgcattttccaaaaatatcagctatagttctatcatttgaattttttgattttttcctgtaaaaaagaactgttgtttttatcaacagttcttaaaattgactattcttcaattttctttctttttaataatgtcactgctgctcctgctaataacattattgctgttatttgattaatttctttagcatcacctgtttttacagtgctatctttaacagtatctcctgactgtaatggcttttcttctttttcttttaatccttcaatgctttcttgtaaattcgctattgcttcttctactacggcatatccggcttcttcattttctagagcatttttagcattttctaatgcttttaccatcgcttgccatgatgcttcagtataatttgcttgattcaatgcttctgcttgtttaatcaattctgccaataaatctttatttggtttcaatcttaattctaagaacgctttgatcaaatcagtatacgtttcttctacttcattttgcattgcattttcatcagctaatacatcttttgcttcagtcaatactggtaacattgcattccatgatacttcactataatcagctttatttaatgcatctatcttgtttactagatcttgtaataatgtcttatcacctttgtagaactctaatttccacatcacttgagctaaacgatcaaaagcattatctactatttcttgagtagctttttcatctgctaaaacagcttttgcttcatctaaagcaactctaaattcatttacaacagcaggaacgactttatctaaatcagcttcactaacttgactagcaatatctactgctatttctaaagcacctttataaactttatctgcaatatcaattttttcaagagctgcgattgcatcattaagcatatctaaagcttcatcgatttgtgcttgtgatgttgctgtatttagtaattcagtcgcatttgcaagagcttctttgaaggcctcttttgcaggtccatctttatatagatccaaattcaatccacttgcctcagttactaattgactaagttcttctttatctaaaataacaacctctttcaaagccatcatcgcatctttaagagtattagctgcattatctattacttcttgatttttagcagtagataaagtatctttagctgcctggtaagctgctacaaatgctgttttctctgcaccatcttgatatttagaaagattttgattaattaaatcagctgctgaaatctgtttttctaactcactaaagtctagaacaactacttcctctaataatccttctgctttttctaattcaattttagcgttatcaactgctgcttgagtagcattttcatcagctaaaacagcttttgcattatctaaagccactttaaatccaacccatgaatctgcagtgtagttactttctacataatctttaaattcatcgtattttgcttgtaatccacttttatcaacatctgcagtattttcaactgtaaatcttaattctgcccatgaagcatggtcattataatcattaccattagtatcaacctgcatgatgatattgctcttacctgttacgtcaatatcgatctcttttgagcgtaatgctttcatttgaccagaattataaatctcttcaccatctgcaaatactctaaagattacatcagcacgatcatctccagtaacagtttgattagaattgattccaataattcctttcaaattagtataacccttaccagctacatttactccaactctacttggcgcatgaactccaacacctttagcaaaatcagttacaacaccatctacatataatgaaattggattagcatcacatgcatctctgctgtttgcaaaatatccgccttcatctatcgtccattccatatctgaaacatacatttcatttacttctctaaatgtaattgtataagtttttgtaacaccataactagatgttgctttgattactaccaccgctggtagactatctggctgattaaatttttcgacaacaacattaccatcagtagtaactacatctactacaggaagtttatcatatgagccttttaataacttaacttcatatgaatctttattgacatcaaatccatcaagttctacaccatctactaaaatagatttaattggtaaacttgattgggtatttttattactttgttccattagtgtatctacatcatcagtagcaattggaacaattctaaatgtatgtgaataagtttgaccttttttgatcgtatattgatctaatggtcctggtccacaagctgctccacctaatccgcgttgtacctgatcaacattaagaacgatatgatcagattttagaacttgatacatatgacgattaccggccatatcttcatcttcataacgtgatacagaactattcatatcatcttgagccgcaatcatgaagccaacaccagcatcattagttactgcagcccaacgaacatcagttctatttccgttttcttgcggtttcaaatatttattttctgcatctattgcatcaacagttgttttatatacatcaatcaatgctccagtatttctatcgttgtaattttcaaatggcccgcgaccataatatgtataattactaaattctgttggaacatttaatttcattccgattcgttttaatgaaccagaaattgtagtcgctggagtaacagtattagtaacaacgacttctccattaccataaatttgataactaatcgtattaggcgaatcacttccatcaagacttcctgttacttcaacctgtactaaattagctccttttgttacttttacatcagatacattgaaatgatcttttgtattaataagatttgcatcatctgcttcatatacatcatcatcaatttgtgctcgataataattaggagtaggtccttcattcattattgtcttaccagcaaatgtataacttgtgatataacccgttgttttatctaatgataatgcataatcgttaccatttacgttacccataatattcaatgcttcatctgtttcttcaacattactaaattcattattaccatcaatcgctggttgagcaattgttgtaacatatgctaaattcaattgttcgtaagcaataatatcaccggtatgaccactataatcaccagcccacacttgatcttcttttaatgtaacttggaattctaagaaataatctctaccttctactttttcaacatctggtaaatcaaccgtaatctccttttgtgataaagccgctaaatctttttgttcttcagataaagtaccttcttttaatactttattattttctttgaactgccatgaaacattgtatttatttaaattagtatttaagaattcgttaacaacgcgtactgtaccagcagcagcttttccatcattatagaagtttacttcttggaaaacttttttagcatctaatacttttgcagcagctgtacgatctgcattaacgataccattaccacagaaattattatcatttacacgttggtcattccaatcgccaccatatccccaatatgtttcatcttcataattagttccagtagtagttattttgctattagcaaaatccattgcataaattacactttcatctgtttcactgatattatcagctgcaatttcttcagctgttaatgcacgatttaatactttaacactatcgattgcaccactccaagtacgtccagaattttctggatcatacccaacaccaatactaagtgaatttgtgtcaaatggagctgtagctttattagctaactcggatattaactctccattataatataatttataatttccatcagcatcacaagtagcagttaaatgcttccagtttccatcagaaaaatccgtaggaagtgctgttgttaaagtccctgcagtccatccattgacaaagaattcaagctttccgtttctatcaatttttaagttataaccaccagtatcacctttagataaaatagcttgatcaccacttgcaccaccattatatttcacccaggcatctaaagtaagacctgtgctagaattagccgttaaatccgttttagccggaagggtaacataaccatttacagcttttgttccatttcgtccatctatcaaagaaccaacaactgtaccaactgtatcagttttagtatctgtaactgtataactttcagtattaactacttttgtctcgatagattgatcgatccaatcccaaacaaaaccaccttgagcattctcataactacggaatacatcccaatattcttttaagttacctaatgcatttcccattgaatgtgcatattctgattggatataaggtaatttgttacttgtatttgttacttgtgaaataacactagatactccccaatattgtgagctgtagatatctaccatcgattcttcacgcgtagcaccataacgattttggcgttcgtatttacgaatacgacttggatctctttgtaagatccatctcgttgaattccagaatgggaaatcatctgtaagtgcataatttgtataagttgcctcatttcccaaagaccaaatcactattgatggatgatttttatcgcgctcaaccatattttgagtacggctcataaccgcattgttccaaatacctgtattaggtaaatttgaagaagttgcaccaatatgtgtttcaatatttgcttcatcacacatatagattccaaattcatcagctaaatcgtaagttaaaacattatttggataatgtgaagtacgaatagcattgatattatgttccttcatcatctttaaatctgttacaatttcttctttaccaattgctcgacctttatctaatgatgtttcgtgacgatttgttccacggaacataatcttttcaccattgatctgcatttgttgttgcccagcatcattgataacaacattttcaatttttctaaatccaatcctttgtactgctgtttcaataacttcacctttactatctttcaattgtaaaacaacacgatacaaattaggtgaatctgcaaaccatttcaatggattaataacctttgcacttcctgttttttcaattcctaaatcaccgattaattcttcaagattttcttttgcaggatctaaagtgtattccattttaatcggttcttctaaaatcggatcatcattttcgtttgaataaagctgtgcttcaactgtataatctccacctttttcattagcaagatttctaactgatgcatcaatagttaatgtagcatcttcattattttcatctaattgttgtttaatgaagaaatctcttaactctactgtatctttagaatatagatagacatctctaaaaataccactcatacgaataaaatcctgattttctagataactacctgttgaccagcgatagacttgaactgaaatcgtattttcttgtccggcaatactaccattagcatctgtgtttaaataaggggtaatattatactcatcggcagtatagctgtcttcaccatatccaactttttgtccatttacataaacataaaaagcagactcaacaccttggaaggatacaaatacttgtcgtccatcccaattttcgcttattttgaaattacgttgataatgtcctacactattatttactgtaggagcgtgagcattagcagcatccaattcaacattttcaaaattttgccaaggatatcgtgtgttagtatagattggcggttcatacttgaagctgccatcttcatttctaattgtttgaatattacttggcacgttgattttgtcccatccttcactgtcccaatcaatcgtattatcatctgggtcactaatacgctgtgctggattttgaacaaatttaaaatcccattcaccatttagagacgcataataattcgattttgaaggatcttttgataatgcagacttttcattatccattccaactttagcatcatgatatggaataaaactagaacgcgcatattctcgattttcttcaacgatttctaattcatcataccatgattctccttcatatggactagcagcactgactaatatttgtcctgaggttgcaagacatccaatagtcatcgcactaaccaatatggaaggtataatcttcttcatttctttatcctcctccttttcccttatattagttattttatcagttaaaattttaaattgtaatgcaaaattttattattcataggaaagaatttattctctatatttgtaataacaattaaacataagattttttggttaaataaattttaaaatgcagtaaacaaaaaaagctgaataaatcagctttcttattttacagttactaattctaaataacttgtagttcctccaacacctggagttcctgctgtaattaaaatttgttcgcctggttcaacaccattttcttttgcaagaatctgtgcgtattctatttgagagacacgatctcccatccatttacaaacaacaccttttacaccccagtttagtgctaaagaacgagttacaggttcatttggtgtagcagcaattatcattgattctggacgataacgagatacacgtttagcagtcgaaccactttctgtatatactacaatcgcagaaactttgaatttagatgcaatttcagccactgacatacaaatagcttctgaaggatcttctggtgctgttctaatagcttttcttaaaaatgacgcataatctaaagtttcttctgtttttaaagcaatcttagtcattgtcataactgcttcttcaggatatttaccttgagcagattcaccagataacataatcgcatcagtaccatcataaatagcattagcaacatcgcttacttcagcacgtgttggtcgtggattttcctgcatgctgtctaacatctgagtagcagtaataaccactttacctactgcacgacattttttaattaatttcttttgaatcaaaggtacatcttcagcaggcacttctactcctaaatcaccacgagctaccataataccatcggctacttttaatatttcatccatattatcaacaccttcgctattttcgattttagcgatgatttgaatttctggatgtccattttcaatcaataattttttaacatctaaaacatcctgcgcacgtctaacaaatgatgctgcaataaagtttaccccttgttcacatccaaaagttatatcagctgtatcttttggtgataagtagtcaaatcctaatttgattccaggaacgttgattccacgtttatttttaactacaccatcatttgcacatacacaaacaatatcagttccttcaacatggtcaactaataattcaacttgaccatcatttaccaaaataaaaccaccaggtttaacatcttgatataattctttatatgttattgtgaaacgatcacttgttccttcaatatcttcttgacaaatagtaacaacttgaccttttttaaactcagttttaccacctacaaaatcacctgttctaatttcaggccctttagtatctaataaaattgcaatatttttatttaattctttacttaatttacgagctgtaataattcttccaccatgttcttcataatcaccatgggaaaagttaagtctcattacattcattcctgcaagaattaatttctttaacatcttttcatcttcacttgcaggtccaatcgtacaaacaacacgtgttttcttttttctttctttcaattcaaataccatacctaatatcctcaccttacattaatttatattaacgaagcttcattgcatcttcgtaaataccaaaatctgtcttacgcttttgagataaagtttctgtaatatctaaacctttaatttctccatgaacttcactcacacaaagtccacctttacctgcttctaataattcaaccgcatatacccccatacgtgaagcaagtacacgatcacgtgctgatggacgaccacctctttgcatatgacctaaaacatttgcacgagtttcaaaacctgtttcagcttctactttttttgctaattcatgaacatcagtaatatgttctgtaataacaacgattgcatgttttttatctgattttttagaagcttttaatctttcgatcacttctgcttcatcataaccaatttcactagtaatgatcatttctgcaccagctgcaatccccgcattaatcgctaagtcaccacaacgacgtcccattacttcaagaatagtgcaacgttgatgtgaacttgatgtatctcttaaacgatccaaagcatcaacaattgtatttaaagctgtgtcaaatccaactgtgtaatctgtatttggaatatcattatcaatcgttccaggaattccaatacagttgacccccatctcagtaagttttaaagcaccggtatagctaccgtccccaccaataactactaatgcttccatacctacttttcgcatttgctcaattgcagcttttctaatttcaggatctttaaattccggaaaacgtgctgattttaaaaatgttccccctaagttaataatatttcgtgtactgtgacgatcaaatttaataaaatcaccttcgtacaaacccttatatcctaaacgaaccccgtatacttcgattcctttattcaaacatgttcttgctactgctcgaacagccgcgttcattcccggagcatctccaccagatgttaatacaccaatacacttaaccattctttctcctccttataacctctatttccaagacattttaacacaaaaagattgatgtttccatcaaatctttaatattttaaataaaacattaagatttttttatcgtagatctttaccctttaattctattggaatgctgattgcttttattctagaaatcagccgttctaccctttctttatcgccggtttttaaagtatatattttttttaacttttccaaagaatattcacttgtaaaaaaagtagctttttcattttgaagtcgatatgccaaaactgcagaaagaacttcatcacgtgaccatgatgtaacactttcgccccctacatcatcaataaccaaataatcaagatttttcatcagctcgattgaactatttactccttcattaccaaaagaactttttagatccattaaatacgttggaaaatgaataaaaccgcatttatatcctttaataaccaaacagcgaattaaaaatcccataatagtactttttccactgccaccatcaccataaagataaaaacctttatgaactggattttttatataatcactcatcatcttgataattgctgtaccattgcctgtagcatcattttttaatgttaagtcacttggcttagtaagcaaaatacggctactaacatttttgagtaaaatactatttaaaatattctgttcatcaaaatatgtttttccatattgacaaggtgttaatgataatttgatttcaccatcttgatagttaaattgtcgtaccatccctttagaaatcttagtacattcctttaaagaccgacatcctttgcaaatatctagatcctctttataatctaaaaattcaatccaattttcttcaatatcatgacgattcaaatgatatttttctaatatcttaactatattattatcatttaataattcattaatactattttctttatttttattaaaactttcatcattaataaataaattaagaccctggatacttttcatgctgtcctcctattcaaactggctcaagaactcttccaactcagtttcatcaatatctttatcatcaaccatacttatattttcttcttcaagatcactgttattacgacgatattttaaatacaaattagcttcatccatagcttctttaaccgtttttatttttttacgtttccactgtgaagcacgtgactgcataaatgctcgtgataaaacattgtcgcattgtgacagcgttagctcaatcaagacattcattactccaggttctaaatataaagatgtcatgatagattcaacaatttgcaaatcatgttttaatggctctctaccaccctgcttatcttttaaaagctgataaggattgatactttctaaataacgaatatgcatatttaatggatcatcaccatgagaacttttatgagctataggctgtttatgatatatttcattaaatttttcaggcatcattaaatcataatgatcacggcaattttttattaatagtttatgtactaatttatcattttgaatgctgtctttgacaagtccctgcatatctaatgcattgatactatacaatgttcccagctgtttaataattgtttcatcatcacttgttattatgcttctttttatctgataatcttttaatccttgataaaatagttccaaatcatactcactttcaattttaccataatcgctgttaaaataatctttctcgactaatatctcattacttccctctaataaatttatatcaaaaacatctgtaaatttagcagtaacattatcataactttgatcaatatttacagctgatgatttaaaacacaatttagtgcgatacaattcttcttcacctaaacgctgtaataacaatggtcctaaaatagtatgattaaaaatcttagctggtgctaatggcgttttgataacatataaatagattcttttattttcaatatcttttttatatttagctaaaagtccaatagcttctaatttcaaacttgcttcatttatttctgctagtgataatcctgttattttggttaaacgactaaaaagactcggagccttagttaaagtaagttgatctaattctgcataaagacttaaatataaactacatgccatgtttccaatcagtggttgatataataatgatatcgaacgcatatgaatactgtcaaggggataattagcattaactgtatacagatctgacatcattgatccattcatactatcttccttccaatagagcttcaatttgtatatataattgttctaatccttgattattatctaaaacaatatcagcacgaagtcttttctcttcaatgcttatttggtttgcaataataactttggcataagcttcatcaatgttatcacgtttcatcaatctttttatttcttcctgttcgtttaaatataccacaattattttatcacataaatactctaaattattttcaaataataatggaatatctaaaaagataaattttttatcctgattatcagcgattacatctttaattctttttatcacataaggatgaataatatcttctagatcctttttagcttttctatcgttaaaaacaattcgtcccaaagctttacgatcaattggtccatcagctaaattaaatctttgcttcgtcctattaatacaatcatcatcaatagttaaagcatcatatgccaatttatcactatcaactactaaataacctttttcctttaaataattagttactgtacttttaccagttgcaatactgcctgtgatccctaatacttccacttacatcttctccttgatcatttctagaattttagcacaatttaaactattatcaagactcatgatcttactttctaatttatctctttcaagcaaatcattaaagtgagctatttcactataaaaatcatcgtaatcataatcaaaatgtttattaataatttgcccatcatttaagataatttcaatatctaaagggcgatgtaatggtttgacgatcattttaccaatacttcccgtaaaaatagcccgattttcttttttgcgatccatcgcacattcaactattccaatttgatcattaaattcaattctagcattaacataactatcgacaccacattcatgatgtttagacgttactgttaaatcacttatcgcagctttaaaaaaatcatctaaataactaatattatagattcctaaatctaacaggcagcccccttgtttaggatcaaataaataagaattaggatcatactctaaatgttcactgcaaaatgaagtttcaattttttcaacttcaccaattatcttatcttcgagtaacttttttgcttctttataacatggtgtaaacttatttttcatcgcttccatcactaaaactttttcttttttagctaattctttgatttctagcatctgttgactatttattgttgctggtttttcaactagaacccttttatgagacaaaatgctttttttgatccattcataatgatagtaatgtggtaaagcaatatatacagcatcaatattaggatcatctaagatttcttgaaaagaaccataagctttatgacatggaaatttttgtttaaacgcattagccttttcaagactgcgacaacttacagcttctaaacaagctcttttatcattgcttaaagctttacaaaagcgatgggcgattcttccagcaccaataattccccattttatcattttatcgcctccttttttgacaatgtttacaataatacgttcctcgacctttgatagcctctttcgttatatcaccaccacaaataggacatttcttttgtaaatgagcctttagcttcacttggaacaacccatcaataccattagcactaaatgagtgaatcgtcgtaccaccttgtttgatggcttcatttaaaatatcagaagctgtttcctttaattccacaacactttttttagttaatttacaagctggcgtatgaggatctaaatgcattgcaaaacatatttcattagcataaatattgcctattcccgcaattatactttgatctaaaatggcatgtttgattggtaaacggcatttatgtaactttgtatatagctctttaacatcggcctcaaatggctctggtccaagtttcgaaagaggcagttcatttgcataattatttaaatcaactaattttatccgtccaaatttacgcgtatcattataacgaagctgtttcccgttatcgagattgaagataatatgatcatgcttatttaagggcatatctttatcaacatagtggtatttcccttccatccttaaatgtgagacaaaagctatgtcatccaatttaaaaatcagatattttccgatccgatcaatatcattaattttttgatcactaactgctttaataaatttttcaggatcatcttcgataatcttaggataaataatatctacacttgtaatctttctttctaatacaaagttttttaacgtccttctgactgtttcaacttctggtaattctggcatctttttcacctactttaactcataccaattttttgcataagtcccttctgcttttaattcaacttccatactaacagcatgttccattccctctttaacaatattcatgacatcttctaattcatcttgatatacatcaaaaatcaattcatcatgaacttgtaaaatcatttttgattttaattttttttcttttaaagcctgatcaacttgaatcatcgctaattttaagatatcagcagctgatccttgaattggcgaattcattgctaaacgtttgccaaattcctgacgtacataattcttttctttgatttccggaatgtagcgtttacgatttagaatcgttgatacatagcctttttctttagccatcgcaattgactgatccatatacgttttaatctctggataagtggcaaaatatttttgaataaaatcccgagcttcttttacacttactccaatttgttccgccagcccaaagtcactcattccataaataattccaaaattaacagctttagcatttcttcgcatttgtgaagtaacatcttcttcagggactccaaaaacaacacttgcagtatgacggtgaatgtctttatcttcattaaaagcctgaatcaaagattgtacatgagctaaatttgcaagaactcgtaattcaatttgggagtaatcaaatgaaacaagataatcgttttcaggaataaaagcttttctaatcaactttccttcttctgtttttacgggaatattttgtaaattaggatcggttgaagaaagtcttcccgtttgcgttaatgcctgattatacatcgtatggatctttttatcaataaacacttgatcttgtaaccccactatataagttgatacaagttttgtaagcatccgatactctaaaaccttatcaataataggatggatatcttttaatttatttaagacatcaacagatgttgaataaccggtcttggtttttttagcatgtggcagctggagatcttcaaataacacttctcctaactgtttaggcgaagaaatattaaattctttatgcgctaataaataaatatccctttgcaaaacatcgatttgcttagaaaaatcagcttctaactgttttaaaaccgttaaatctatttttgccccttgaaattccatttctgctaagattcgtgaaaccggcatttcaacatctttatataattcatactgttccttagctttaagtttttcaatagcctgatcctttaaatcataaattgcttttgcttgtttgatcaagtgtttagcaagttcttcagtttcaggaagatgttttttggctcctttgccataaacctgttcatcatataacacatcatagtattgataaaactcgcaaacacttttaatttcatcttttaatgatggattgagaatatatgaagctaactgcagatcaaatgtgtaccctctgagttttaaaccgttccaagcacaggcattaacacattttttaatatcataaccatatttttcaatcttctcatcttctaaatatgctttaaactgctcacatttataagcatcatcaaaagaaatataataactgcattcatcgttataaatagcaaatcctaaaactggtgatttatgataattagtatcataaacactaacaaccaaactagctggtttatcaattattggtaagtgatcaacgatttgcacttcaatttcatctttcttttccacttgatgacttaaagacattctttttaataaagaattcatatcatagcgtcgatagaaatcagccaactcttcataatcatgaccttcataatgccatttttctaaatctaattcgatcggaacatctaaacagatcgttgcaatctgtttagaaagaacaccaagttcaatattagttcgaactttttcgcccatttttccttttagatcagccatatgctcttgtaaattttcaattgattcatattgatgtaaaagctttaatgctgttttttctccaattccaggaattcctggaatattatcagcagtgtcgcccatcaaccctaatagatcagtcatttgttgaggctgtaactggtacttttcataaaagctctcaggtgtaataatttcatattcatcgcttttttgcggctttttatactgataaacagattcattaacaagctgcatcatatccttatcattagtataaatagcaacttttaagccggcatctttagcttttttagataaagttccaataatatcatcaccttcatatccctcaagttctaaataaggaatgttatgagcgcgtaaatattctctaaccattgaaaactgacaaatcagctcttctggtgtttcttttcttgttcctttataattttctaataattcacttctaaatgttttccctttagcatcaaaagccaccacgatatattcgggattttttcttaataaactttctaaacgattggcaaaaccatatactgcatttgtcggcacgccatctttattgaccatcaagtttcccattgctgctgttgcataataacaactaaacaaccaaaaatttccatctattaatacaaattctttcatcctctatccatccttaacgtacatttttagcctggtttattaccagcgataatttatcgcggaaattcacttttccttcaatcaaacaaatttctccacgaactaagattttttttaaaacctgaaaactacttgcaaaaacaactccatcaatttctccagtttcatcatagccttcaacaaaacacatttcctgcccttttttatcaacgataacttttaccctcgataaagccattataactctaaccggtttattaagatagtttttcaattcatttatgctgataatttcctgctttatattttcttttatcaaagcgattggatgcattgataaataaactcctaaaacaagtttctcttcttctaaaattttcattcgattatctttaacgatcgttaaaattggcggttcatcaatgccaatcgaattctttaactgcacatactccgtgatcttatgtaaattttccttgatcgtactacggttgagcttaaactcgtcaaacgctccagccatgatcaaactatcaatcattttactattaagtttacttgactccatccgagaaacaaaatcaaatatatctttaaacaaacctttctttctttcttcaacgatagcaagatatcccgcatatccaacgtttttgattgctaaaagggaataacgaatattaccatcttcaactttaaaacgattagtcgaataattgatcgatggtggtaaaagcctaattccgtattttctaccctcttgaatacagcttatcttactgctgtcactgctttgttcattagataataaagcactaaaaaattctaaaggataattagcttttaaataagctaaccagtacgctacgtaaccataagcaactgaatgcgacttattaaaaccataattagcaaatttttcaatcaaatcaaaaactttattaccttcctcttcactaaaaccgttattaattgcaccagttataaactcacttttcatcgaagtcattaaactaacggtctttttcgatacggcttttcttaaaatatcagctttagctaacgaaaatccagctacttttctagcaacctgcatgatttgttcctgatagatcattatcccataagttgaagataaaattggtttcaagcattccaaaggatatgtaattggctcttgaccatttttgcgggcaatataagccgggatattagccattggtcccggtctaaataaagcaatggctgcaattatatcatctaaacaattacacttcatcttaattaaaagatttttcattcctggtgattctaattgaaaaataccaaaagtatcaccactactaattaatcgatatgttttttgatcatcaagatcaatttcattaatattaatttttatatcataatttctttcaatatctttgatcatataatcaattatcgttaaattctttaatcccaaaaaatccatttttaataatcctacttcttcgatgtaatctttcgaatactgggtcatgatgccatcattcggtcccttgactaaaggaacgacctgatctaaaggatcattagataatactactccggctgcatgcgtagaaatatttcgtggtaatttctcaacagtaaaaacagcaggcatgatttttagcaaagcgggatctttgttgaccatggattgaaaattatatgatgtttcatatacttctttagcactcttgcgatttttataattagtgggaatatttttagctaagagctctaatttcggtaaaggaacttttaaaactttacctaaatcttttatcgctactttaggcccatatgttgaaaaagtaacaatttgcgccacatgatcctgaccatatttattagtaacataggcaactatttcatcacgccgatcatcttgaaaatcaatatcaatatctggcatgctgattctttcttcattcaaaaaacgctcaaacaacaaatcatattttaaaggatcaacattggtaattcctaaaacataagcaactaaactgccagctacagaacctcttccaggacctactaaaattttgtttattttagcatatctaacgtaatcaaatacaattaaaaaataatcatcaaagcccattttagtaatcacatttaattctttttttaatctttccaaataaatcgttttgatctgttcacctttaaaacgtttctttaacccgacaatacataattgacgcaaatattcacttgctttaccatttttaggaacgggatacttaggtaaatgcatctgatgaacgggaatcgtcgcattacataaagtaataatataatttgtattttcaatatattttttatcaaagatactttccatttcataacttgatttaagatataactggtcggttactggaacgtgatctaactctaaaatcgatcctttagaaaatgcttgtaacaattctaatgtataagcatctttactatcgagataacggacctcattggaaacacaaacgggaatattttctaacagagacaaagcaatcaaacgttcatttatttttttttgcatagcaaggccatgatcttgtaaacaaacatagaaatatttaaaactttttttaaataactgtaaatatttcaaagcctcggattctaattcctttaaaagcaaccgttcaattattccttctttacaggctgataaaacaaataaatgctcctggtattctatcaatttttctaatgcagctgctttattagcatttcgcgatatatcactcgctagatgtactaaattaaaatatcccgttgtatctttagctattaaaatcaaaggatatatctcctgttcaatttcaatactagcttcgatcccataaataggtttaatcccgtatttatgacaatagcgggtaaactccatagccccgaacatattatttttatcagttaaagctagtgcctctaagtggagatcactagcttttttacataagtcttcaattaaaatcgtgctatcttgaaaactataagaactatatacttgtaaatgacctagcattatccccacatcctttcaaattgtattataccaccaaatagtctatttaaaaatgattattatagaattgcccgaaatgaaaataaaataatcatgattgccaagtataaacaaagacacatataaagcgtatcaaaaaaagcaaatgttgtaactgctaaaagccagactctaaaacaatataacgccaaaacataataatgatactgaacttgtaaaacacagaaccttttttgccagccaataataataattgaaagtatggcagcaatcaaatgaaagggaatgatccacaatgggcatattacctgcatcagtaaaattataccacaaataaattgcaattttttaattcgtatcaacatataaccacctatcgtattatatgaaatttaataaataaaatgaaaagaagtggataatcaaaagattattccactacattgcatgcttaataagtgcttttgctaattgatcaggacaactcgttggcttactgccacagcgaattccttgtaaacgttcaacaatatcagtcactttcattccttttgctaaagctgctacaccctgagtatttcccgaacatcctccaacaaacttgacattattaacgataccattatcaacatcaataataatttgtttggcacatactccttgaggttgaaatttaatttccatcatgacccctccttacttataaccattataattataaataaaaataatgcaactattttactttctaactaactttacgatcgtagtcaagtatgaattatgacatgatgaatctaacgccacgattttttctaatcgataattgttttctaattcagccaaatctttagccaaggttgaatatgactgacaacaatagataattgttttaatttttgcaatcttaatactatttttgatcgtctcgcttaacccaaaacgttcattttgaattatcagtgtatcatagattttctttttagcataaataacgattttttgatcaagatcaccagcaataaaagtaatattctctttacgcttattatttattttagcatcttcaatatgatattttttctcatcaatagcaaccacttcttcttgatccaaattagattctaataatcctattccacaatttaaagaaatgattttttgactatcttgtaacatcgctttaatacattgaatttgtttatgatatacagcaatattttctggtaatttagactttgctgaaactagatactttttatcatcattatataattccaaatgactaggaccgtataactttgtataaccggaatcatcaaactcttgatgtttagaagtattaatagacatataaacacttgcaacatgtggtatttcagtaatttgacttactattttacgatcaattccatcacgcccagtaataaaaactaactgaatctgtttatcaatcaattttactttaataaatcttaaacctgttttaaatttatcattataaatctgacatttattactcgttaaaacattttctaaagctactaatgtttcattgatcaaaggatgctgtttaaaacactttgtcatcaatgttaaatacttgctatcacgctgataaataccaaatgtaatctttcccttaaattcaacgattggtaaattgacactagtaataaacccttcttgtttaggtgaagcaataacatctttaaaaacagttttgtttaaatcatattgggtatattttctaattgcctcgcgaacagcttcctttttagctgttaactgcttgtaataatctaaatgcagcaaagtacatccctggcaattatcatatgctttacatcgaggaataacacgactttttgatcgtttaatgatcttgatcagctttccttcataaaatgatcttgtctgctttgttatttcaactacaacttcttcttctggcaaagccccaggaacaaaaacaatctttcgatcaatatatccaattccttcaccattaattcctaactttttaatttctacattttttttcatcctacaatttcctcttcattttcaacttcatcaagaatagtcacttttaactgtgcaattctatttttatgcatttttactattctaaacaatacattttctatttttacttcctcatctatttctggaacttttgaaatctctcctaataccagaccaccaattgattcaaaatcttcagaatcaaaagatgttttcaaacgatcattgacttcatttaaattcaaacttccatcaaccaaatattcattatcacctaaagaaataatttcttcctcttcttctttatcatactcatcatcaatttcaccaacgatctcttcgacaatatcttcaaaagtaacgattccactcattaccccatattcatcaagaacgatcgctaatgttgcatgctctttacgcatcaatgcaaaaacatcagatacttcattaaattcataaacgacaaaagtatctcgcatataatctttcaccgaaaactcgtcaggatcaatattaaaaaataatagatctttaacatttaatacaccaacgatttcatcaaatgattcactatgtacaggataacgtgaaaattgactgcgctgataaatttccatcaattcctgataagaacaatcatcagcaatactttcaacatgtattcttggtgtcataatttccttgatttcagtttctccaaattcaaaaacattatgaatcatttctttttcttcttcttctaaaaccccttcttcatgaccaacagtcacgatcgtttttaaatcttcttcggtcattgttggtccattatcacgattaccgcctaaaaccttaataaagaaaccagtaattatgtttaagaaaaatactactggtgtaaaaataaagcaggcaaaagatgtaaatcgtgatagaaacaaagcaattgcatcagcatttttagtagcaaatgattttggggtgatttcaccaaaaataagtattgtcaaagttacaacaccggttgctatcgcgactaaagtaccggaatctccaaaaagagaaattacaaatgatgtcgttaatgaagaagcgccaatgttcactaaattatttcctactagaatcgaactgaataaacgatcatcattagataacaatttttctacaattgctgcttttttatttccttcttctgctagattacgcattcttattttattaacagataaaaaagctgtctctgtacatgaaaaaacgcctgaaaaaataattaaaatgacaaatattataatattgactatctgggtcgggtccacaataaatcttatctccttatattcattaattttatcattatcatagtataaactatttaaaaagtcaaattatgttcatttgaatcttatattttaaataaatcataatttttaggataaaaaagtatagtaattatttgattttaatccacaacaaataaaaaacaggcaaataaattttgcctgttaacctaacataattacgatcgtagaaccagcctctacatattctcctactcgtggtaattgattgatcaccttatcaccctcaccaataaatttgaatttcaattctggattactcacttctttttttgttttaccaatataattttctactttaactgttttagtatctgtgatcgtataagctttttggcgctgtgaagaaaccttttcgattcccatgcttggtaaaatatccactaacatctttcttgcaatcggagcaacagtcgttcccccatactgtacacaatttttaggattatccatagctacatagagaacaatttgtggatcatcaatcggtgcaattccaataaaagaaagaatataaccaccatctacataactaccatttactgctttttgggctgttcccgtcttcccgccaattcgatatccatcgatataggcatttttacccccaccatcggttactactgtttccaaggcatcacgtatttttttagaagcctcttcactaataaccgtccgcaaagcctcaggctgcttttcataaataatatcattagtataactgtcgattattttatcaactaaatacggctgatataatgttcccccatttacacaggcacatacagctcttaccagctgcattggtgttactgaaattccctggccaaaagctacagttgcctgttctagttcattaaaagcatcataatcaaacatgattccttttgattctccaggcagatcaattcccgttttttccgtcaaaccaaatttctttacatactcatataatttatcttttccaagacgtcgtcctatttctacaaaaccagggttcgaagaattttgtagtacttccctaaaagtttgcagcccatgaccgccttttttccatgacttgattcttgctccgctaacaatttcatatccctgatcataataagtatctttatccatatcgaataaattttcatttaatgctgatgcaaatgtaattattttaaatgttgatcctggttcataagtcttccaaatcggaatgttatgattataaacatctttatcagcattttggtaatcattaggatcaaaatccggcttacatgccatcgctagtattttaccagtagctggttccatcgctagagcccagatcccatcaggatcatatgtgtcataagcattatttaattcccgttcaacaatatcctgaatgtcaccatcgatcgtcaactgtaagttaaaaccactagttggcgcactataaacactgggatacaatgtcaaaggattactcttagcatccatataataatcgatactaccattattcccatttaaataactatcatattttagttctaatcctaacagcccctgattatcaattcctacaaatcccaatgtttggcccaaataattacctttaggataatatcttttggtatccttgattaaataaactccaggtaattttaaactgcttattttagcagcaacttcatcatctaattgtcgtccttctggttggatccgttgaatagatacttttttacttaatttttcctgcatgactttaacatcaacttccaaaatatctgctaatttttcagctgtcatcgtaacatctttaatttgactaggaacaactactaatgacgatgttgttaaattggttgctaaaacgttattatcactatctaatatcaagccgcggttggcttcaacaggaaaacttctttgccacagatctaccgctttattataaatatttacacgatcaacgatttgaatataaccaatttttaaaattattgctattacaataacgaccgttataatttttacccattttattttatgtttagttatttcatatatcatcttaatcacctctataatatatgaaaaaagtaaggtcattagaccttactgtaatgtaatagttaaagcatcaccgctatgtaaaattgttccttctggtaaactttgactggcaacaagaccatttccaccatcaatactaatgtttaatcccgacaaggagccaaacgtcaatacatctttacgcgaccagcctgtgaaatttggtaatgtaatatccgatgattcggttttaatgaaaacacgatcatttttagtgacttttgatttagcttcaggaaattgttcgataactgttgaaccatttccaatcacttggacatttaaagtttttgattctaattttgattttacaaaattaacactttgatttatataggaatctaatttatattcttctgttgctgtttcattatcagcagcattataagaagaaacgatagataaagctgtcggtactacatttttaataatattagcctgatgcgtagtagtatcattatcaggaccttgaaaaacaactatcgagataatttgaggatcatcgtacggcgccattcccgcaaatgatttagtataatcagtcgttgaataagtaccattttcacctaccatttgccccgtcccggtcttaccaataatttgtacaccgttatctaaagcaaattttctagctgtacccatactttcatttactactccttttaataggtcacgcacttgcgctactgttgaagatgaaaatattttttcagaaaattgtgtctttccactatatgtaacttcattattttctttatcgacgatccgatcaactaaatatggttcaaccattttaccatcattagcaaaaacactgtaagcacgaagtaattgtaacattgtaactgttgaaccctgaccaaaacctgttgttaaataagctgctcggctcttatcggtttcatacaaggccactcctgaagttgattcaaacccatcgatattactagattgaaagaaccctaatttttcatatgtatcaataagatcatctcgattagtatatcctttttctaataagttacaaatagcaacattactagaacgataaaaaccttcatcataactaatacttccccaaccagcaccattattatggtctctgattggtcgactaccaccataatcatatttaccagattcatataacgcactgccatcgtataagccgctttcaattgaacttgcatatacgaatgatttaaatactgatccacattcataagctgtatcaaagaaaaaattcttataatcttcaatattacgttcattaggattaaatgatggataactagataaagctaagatcttaccagttttagcttccatgatcactgcagctgctttcgacgcctgcgccccactagcttcaacagctagtgaataatccaaatcacgctgtaaagaactattcaaagtcaaatagatatcttgaccattaacggcatcctgctgttttaatattccattaggcaagatatatcctttagcatctttttgataaactttgtatccattctttcctgctaaagtatcattatatattgcctctaatcccatctcaccaacaagacttttaacattattttcttcaacacttttagcataaccaacgatataactacaaaaatctcctaatgggtagttacgagaagtcgcttcttcaaattccaaacctgttaatttagtctcttcgatctgcttcttttggttagcacttaaattatttccataatttccaaattctacttgatattttcctttatcaatagcttcctgcattttttgcgccatttctacaggatccataccaataattggagctacttcattagcagtctttgtaacatccgttacgtgcgcctctttattagcgtaacctggtcttttactagaaacgaccgcaattaatttgaatttttgaacattcgttgcaattacttcattgtcgctagtatagatttctcctctagttgcatattcaacggtttccactttacctctacttttagcaaaagctttaatatcaccactgctaatcaagtgtttaccagttacacctaagtatacaatatttacaactaaagaaaaaataactagtgcaaagacaacataagctatctttgcacctttaaactgactcattattattcagccggcgtctctgtagtagaggcagctacagattcattgctatatgtataacctttttcacctgcaatatcattaagacgtgaaaaagatgctaattcttgtttttgcatttctaaactatctatttcatcttggagcactttgatttctttttctatttgctgtgcttcttgattgcaagaggactccaatgatcttacataagtgattccaaaaatgaagataaccattgaaatgattaaaaatctttgtgaaaaagcttcaaactttgttttcttaactctatgtctcataattacaccctctctattactcttaattttgcggaatgggcccgatgatttatttctaattcttcttttgaagcaataattgcttttttatttactaatttatatttaggtaataaataatctggaataactggcaatcctggtggcacatcttttaactttgttacgtcattaaaagtatatttacaaatcttatcttctaaactatgaaaagtgatcaccgcaattcgtccaccactatttaataaagctaaagaatctttcaacgcccgatcaaatacattcaattcatcattcacagcaattcttagcgcctgaaaagttcttttagcgggatgcccacctttcctacgagcggctgctgggattgcttctttaatgatttcaactaattgaaacgttgtttcaattggcttgtttactcgcgactgctcaattttacgcgcgattcttttagcaaatttttcatcagcatatttaaatagaatttctactaactgttcatacgaccaggtattaacgatcgtataagcatcaagagaattattagtatccatccgcatatctaatcttgcgtcataattatagctaaaccctctttcaccagtatcaaattgaggtgaagaaactcctaaatcaaataagattccatctacttttgttattcctaaattacttaattctgctttaatattaacgaaatttgaatatatgatcgtaaaattatcacttatttcactaagtcggcttctagctgctgcaattgccgtttgatcttgatcaaagcaatacaagtgtcctgtagtaagacgttttaaaatggcacaactgtgtcctgctccacctagtgtacaatcaacataaatcccatcttcttttatattcaaaccttccactgcttcatttaataataccgttacatgatcaaacattattttctcctataaatcaaatccatctaatgactcagaaatttcatcaaaattatctttatttgtatcataatagtcttcccatcgtgcttgattccaaatttcaacatgatcgccaacaccaactatgatacattctttttctaatttgccttccaatcttaaaacattaggaatattaactcttcctaatttatcaaattcacattcacttgctctagaagtgataattcttacaaaattacgagcttcttttttggttttgggtaacgtttgtaatttttgataataatcattccaaccttcttgggtatataaagctagacaaccatcaaaaccacgagtaataactacactcttaccacattgttctcttaactttgagggaataataaggcgccctttggcgtcgatattgtgtctaaattcacccatgaacattttaatcacccactttttaacactcagtaacataaattaacacttcgtaccaccattatatactttctaaaccattttgtatagacttttcttcaaataagatatttttggatatttaaacaaaaaaaggaccaattaacgtaaaacaacgttaattagtccaatatttttattaaaaaagcccttttatgctatttcttataaaactttttgccctttgtaagtaccgcaatgtttacaaactttatgagacattttgtattcaccacattctggacatacaactacagctggtgctgtaagcttatcgtgagttcttctcttatttcttcttgtttttgatactcttctaaatggtactgccatcagtataacctcctgtttaatctttaaaataatcttttaatttagctaatctaggatcaatgtattcctcattattttcactagcattgctactatctaatattctccaacctttaccttctgatttaatattagcatcatctttgactactctcatcggcacttcaagcataatattttcaaataccacgggagtaagatcaacaatatctttcttcacttcgtgaacatcttcaagaggtgccggtttgtcaaaagcaaacacctctgttgaattaatctcaaaaggatactcaacatcctctaatgtcattgcacatggaagaatcatcgtccccttgatattaagatcaacatataaacgtttatcttttaaatcaagattaccggttcctgagacaataatgtccttcaagtcattaatttgtgcatattggtcaaataattctgaaggaaaagtaagtccttcttcaaattcaaattttccacgatgcttaacaatccattgtaaattgtatttcaaaataatcacccttctataaccgcaatgacaattatatataaaataataccataagtcaacctaaaaaatacttgtttttatcgtttattttacactaacatcttataccatcttatcaatatcacgaggaattttattagttttgatcattgaaactaatttatcaattttccctggactgattgatttattagtcacttttgctaccgaaacaataaaatcgcgaatatcattttcattattcaaatctttagattgtaaatcattggctaattttaatatttcacttttattaacattagttttctttacaaccttatctaaaaaaatatcttcatctttcatattatcaccactatataatatgaaagaattcaaataacgttacccttctatctttaattcccttttcatcaattgttgaatttcacgctttggttcatgattattatataatacattatatattgcattaataattggtaattcaatatcatcatattttttagcatcttcataaataacccgacaagttcttattccctcacaagtctttttgttatttttcataaaagatcgggcatcattagttttaccaatttcaagtccagcttgaaaatttcgcgaatgaatcgatgaacaagtaacgatcaaatcaccaaccccagtaagtcccatatacgtttctaatttgccaccttttttcattccgtaacgaaccatttcagctaatccccgagttattaaagctgcttttgtattgtcaccataaccaagaccacttaacactccggcagctaccgcaattacatttttaattgccacaccatattcagctccgacttcatcggtcaaacgatacactctgaaatagtcattagaaaataatgtctgtacatcttgagctgctttttcatccaaagagactgcacaaacagttgttaacattctaatcactacttcttctgcatgactaggaccaatcaacgaaacgaccggattgatcaaactttcgtccaaaacactgcggatcgtatctgacatccgcatatttgttcctagatcaaatcctttagaagcattgataactgtaatctttttcttaataaaaggttttacctgctgtaatgtttctttaacaaattgggtaggaatcgtaatcaataaataatctatatctttcatcgcttcttctaaattattagttgctttaatttccgtttctaaagacacattttcaaaaaaagcactgttttgatgattgatatttatatcatcgatttgattttgatcgattccatacatcattatctcattttgattatcgattaaaactctacttaaggcagtagcccagctgcctgtacctaaaactgcaattttacacattattacacatccttatattattgtatgtatattataacaaacatcttttcaaagtacactactaatctctttttcgacaaataatgtgaattggtgtaccttcaaagccaaaagcttctcttaaacgattttctaaataacgtttataactaaaatgcagatattgaggatcgttaacaaataaaataaaggtaggtgggcaggtacttacttgatttgcataaaagatctttagtctaccaccattaaaagttgttgttggattgattgcctgagcatcaaccaaaacatcatttaaaacacttgtttgaactcttttattagaattagtataagattcctggatcatcgggaataactgttgaactctttgatgagtttttgctgataaaaaaatgatccgtgcataatctaaatacttaaactgcgtgcgtaattctttttcttttttctgcatcgttttttcatctttttcaatcaaatcccatttatttacaactaagatcacgcctttaccagcttcatgagcatatccagcaacgtgtttatcttgttcaatgaccccacgatccccgtcgattacaacaacaataacatcacttttttcaattgaagataaagctcttaaaattgaatatttttcaacgttttcatagactttacccttttttcgcattccagctgtatcaatgacccgatacttttgaccatctttttcaaaagcagtatcaatagcatcgcgtgttgtcccttcaatatttgaaacgatgacccgctcttcacctaaaatcgcattagtaagagatgatttaccaacgttaggtctaccaatgattgaaaaacgaatctcatctttatcaaattcttcttctgtgaaatccaactttttaataatttcatctaataaatcaccgattccaattccatggcttccagatacgggaattggatctcccatccctaaactataaaaatcataaatatcattaataaaagaattatcatcaattttgttaacggctaataagatcggtttttttgttctttgtaataatcttgcaacatattcatcttcttgagtgacaccttcacgaccattaacaacaaaaacaatcaaatcagcttcttcaatggcaatttcagcctgcattttaatttgtgcagtaaaagatgcattcttaagttcgattccaccagtatcaatcaatctaaattcttttgtcaaccatgtagctgttgcatagattcgatctctagttacaccagcaacatcttcaacgatagaaactctttccccaacaattcgattaaatattgtagatttaccaacatttgctctccctacgattgcaactactccagccatcttatccctcactttccttttgtttaactaattttaatacttcatcgactacttcttcaatccttaaatctgaagtatctaaaacaatggcatcatcagctttttttaatggcgagattttacgattcatatcttgataatctcgttgttcaatatcattttttatagtttctaaatcagcaggcagtccccgctgtttattttctaaataacgacgcatagctcgggtttccacactagcactttgatatattttaagctcagcatcaggcaaaacaacagttccaatatcacgaccgtctaagattacaccaccagccttagccatttgacgctgctgcttaactaaaaattctctaacatcctgataacttgaaactttacttgctgacatcgacactttatcttgacgaatttcactactaacatcacaatcatttaaataaactcggttttcactatccattgtaatcttaatatcttttaagacttcagatacagcttgttcatcacctaaatcaatattgttttgtaaacaataataacctacacagcgatacatcgctcctgtatcaatatatacataatctaattttttcgcaacaattttagcgatactgcttttaccggcagcacttggtccatcaattgcaattgaaatcttcttcatattatcctccctctttcttgaaaaaaactaaggtgaaccttagtttaaaagaataactggtatcctatcataccacataaacaaataaatacaataactaaaaatataattacataatttaaaacattaacaatacgatcatttttctttttctcgaccacttcaacacggctcccatcatctttttctttactttcagtttggacaaccgtttcatttttaatcgtttttatattgtcatctttttctttttgctgtaaagctttttctacttcacgctgatctttttccttgatttggcgtaacatatcttctaaagaagcagtttgttcaggcacatcatcctcatttggctcatcttcaaaaacatttgtctcttcttctaagatgatctttgcttttttggcatcttcagccggtgacatgcttgctaaacgctccatcaaagtcatcttctttttagcttctttatcttctggctgttccgtgttttctaaactctcagcttctttatcaggatttacaaaatatcctttagaaaattgagaggtggcaacattgtcaaacttatcaattcgaactacttgtttttctggttctctaattttatttaaaatatccatccttgtattgtattgtgcttcttttccaacaccagctttagcactgcgcaacgctcgattgatttcttcactactttcttggcgcatctgttcaaatgttttagcttctgttagtgtatcttcgatttcttttttttcatctttatttccaaaaagtcgattgacagatgttaaaaattcatcttcttcatcagtatctatcaccgcgtcaattacatcattcatactatcgcgagttattcctgcttcatctttcaaaccacttcttaaattacgatatttatcaattcgtgaattaaccactcttaatcaccctttcaacgaacattatagcatactttttaggtaattcctttataaaataatggaaaatatatttaatttaggctataatatgagagtacaaaaaaggaggaatttataatggctaaaattacagtaaatgattcttgtattggttgtggggcttgtacagctgttgcacctgatgtttttgaattaggtgatgaaggtttagcagttgtagttagcgaagataacactgacggagctaaagaagctgctgaaagctgccctgttgaagcaatcgaagttgaataatttattaaaaaccaatcgttttgattggtttttttatatcttataaagactttaataacattaacgctgttgctttatttgaggctaatggaatatagtgcacatcacataatctcatcaaagcatttatatcaggttcatggggttgcgctgtaagtggatcacggaagaagaaaaccatatccatttggcctaaagcaattaagtttccaatctgctgatcgccaccatatggtcctgataaaaaacgtgttacttgtaaatcggtattttccataatttttttaccagttgtcccagtaccatataaattatgttttgcaaacaatttttcattttctttaacaaaatcgatcaattctgttttcttttgatcatgtgctatcaaagcaatattcatcttatccctccttgaatttagattctatcggtcttactacataataaacaatagcactaataactcctttaataaagttaaatgggaaataaattataaaaatcgcttgtccataaggagataaaaaatttaaaaacccaggtatagagatattggttccatactgctgattaaaagaatttatatctaatgcaaaaggtaattcactataccatgtcggtttttgcattaaatatgttggtgttacaaataaatagtttaatataaacaaaacaattgcaaatattaacatcgttataaacatatttataatatatgccagccattctttctttaattttaaattttgtgataaaaaataataaacacaacaaatcgtcaaagaggcaatcaatgctgtaatttgaccaattgcaattggtccaactggccctttaaataatattgaaactaaaaacttacaaacacaaacaaataacgccgatttaaagcccagcattgaaattgccatgatcacgacaacctctgataaatccaaattcagccatggcgcaaaaggatatggaatttccaataatcccaatatcattcctaaagcagccaaagcagctgataaaactaattttcttgtcttagtaatttccataataatctctccttaaataaaaaaatatcatgaaaatactaatctccatgacaaaagtacatatatcattaactaataaatgtcattcttccatccagactttactgtcggtgtaggaatttcacctactcagcttgcgctcgcggactataccgccggtcgggaatcacaccctgccctgaagactttcttttcttttagaaatatatcatatttatctttcatttacaacaaaaaggtgctgtttttaccagcacctaataaattattgttctcctaaagttacttgaactgttttttcactaccattacgattaattactacagaaactttatcacctggttcttttgcatataatgcagttaagaaactcttataagtagtaattttttcaccatcaaattcaacgataatatcgccttcttgaataccagcttgactagcagctccaccactacttactttaacaacgtaaataccatctgttaaatctgtattgatacgatagtaacgtaattgataactagaatatccagataaagaaacaccagaaattccaaattgtggtcttgtaacttttccgttttcaataatttgttcaacacttttaattacatcattaataggtaaagcaaatcccattccttcaactgatgtatcagataatttcattgaagtaattccgactaattctccagccatgttgactaaagctccaccactattacctggattaatagcagcgtcagtttgaataacgttcatatcccaatcatcttgaccatcatcatttaaatctacagacactgtacgatctgttccactaacaataccttgagtaacagtaccagcatattcaattcctaatggactaccaattgctaaaactgtttctcctttatctaataaacttgaatcaccacatttaattgcactcaaatcaaaatcagctgttaattttaagactgcaatatcactataactatcactacctaaaacagtcgcagaaactgattcttggttagaaaaaacaacttgaacttcacttgagccatcgacaacatgagcattagtgataatataagcttctttaccattaacgcgatatactacaccacttccgctaccactagcagttccatttgaataaactaatactccgacaacactatcactgactttatcaataacatcacttgtagagctcttaacatcataattaacttgctcaacttttgctccgctacctgataaaacatttgaactaccattattcaattgtgtaaacataaagacattaacgcctaatgaaactacaactaagattactaaaactatttggaataatttaaaattattagatttagtaattctatctttatttttttctattcttgttttcattggctcaggaccagatgatgaatttggcatttcaattttatcatcaatcactttatctgatccatagttagatgccgcttcatgtgagacattttcatcaatcactttttgagtttcatatcctttcgatgtatcttctttagttacttcttctaatttaaagtctgatgttacttccggtgattcacttccttttgatatatcattttcagttacaccttcttttattgaagcttctaaatttgacacttcttcttggctttcgttttctttagttacttcctcttttgttgaagtcttttcagcttctaaattagacattgcctcttgagtttctttagattctagcggtctatcttcaactgtttctttttcatctattaattcatttgtacgatttttatcttccatcttgaacactcctttactttacaaaaccatcataaataaataatttgttcaaattatttttatattgtgtgaaaaaacggtttacttgtaaaggatctttattttgtctctaaaatcggcaaagttattgaaaatgttgaaccaattcctagctcactttctacttcgatcgtaccattatttagttctaccattctttttacaatacttaatcctaatcctgttccaagttttttgcttctagatcgatcaacttgaaagaaacgatcaaaaatcaaaggtatatctgttttagaaattccaattccttcatcctgtactttgatcattaaattttgatcatcatcatacgcttttattgaaataacaccagaattagaatactttattgcattagaaaccaaattattaagaactgttttaattatagtatcatccaacatcagatcatgagatattttagtttgataaatcaatgacaactgtttatctttagcaagcggttcaaataattctactgtatcttttattaataaatttacatcaattaattttggtgataaaactactcgaggctgttctaaacgtgaaagttccaaaatatcttcaataatattttgcatgcgataactttcctttaaaagtatacccataaattcatcaaaagtttctttattttgaattccttccttttttaagatctcaacactaccaataatcgcactcattggtgtctttaattcatgagaaatgtcagaaaagaattgtttttgcattttttcgatttctttaacttgagaaacatctgtaaacaaaataatactgccatcaaaaacaatatcatttctaaatactggtgtcgtttcaatttgataatagcgctcatcaatcgttataacagttgaaaacttacgttcaaagatataactttgatcaacaacacttaataactgtcccttaaaaatatctttataatatttccctcgcaaatgttttatattaaatgcttctctaaaactttgatttgtaaaaattatagttccttctttattaataaaaatcattggtaaattcattgttttaattaatgaattaagtattttatgattaaaatctttttctccttcaacttctcttatctcattttccttttcacgacaataaaaatcgatttgatgtaaatatgttgaatttgtatcataaataatatacaacactaccaatgtaaaaccagctaaataaataaatgcatagctaatattccatatcaataagatacaaacaacaataaatgaaaaaataactttttgataatttttattcatcttttttcaccagtttataaccaactcctcttacagattgaaaacaagcttgactttcttttaatttagatttcaatttaaaaacatgaatatcaactaatctagtatcaccatcatagttaaaattccaaattttcattaataactcctgccgtgacaaaacttcttctttattatccaaaaacatctgtaatagatcatattctactttagtaagatttattttattttcaccaacataaacctcatgcttagttagatccatttttatatccaaatattttaaaattcctttaaaatgtttatgataacgacgtaaatgggcttctattctggcaattaaaatattagcttgaaaaggtttcgtcaaataatcatcagcacccgattcgagtcccaaaattatatcatcttgatcacttctagcagtaagcagaatcattggtttgatatagccactatcacgacattctttaatgatttttatcccatctttatacggtagcatccaatccaccaaaatcaaatcataatcattagaaagaattttttgacacgcatctttaccatcataaagactatctacctgatagtctttattttttaattcatgacttaatattttattaatagatatatcatcttcaataattaatattttattcatctttcccttcatacctttcaataattctttgaacaacaggatgtcttactacatccatcgctgttaaatgaacaaatgaaattcctttaacatcttttaaaatttttaatgcttttactaaccccgattcaactccacgtggtaaatcaatttgtgtaatatctcctgtaataatcatttttgaattaaatcctagacgtgttaaaaacatcttcatttgattatctgtcgtattttgggcttcatctaaaataacatatgcatcttctaaagtacgtccccgcatataagcaagaggagcaatttcaattactcctttttcaattaatctttctgtctgctctaaaccaagcatatcgtgtaaagcatcatacaatggtcgtaaataaggatcgactttttcttttaaatcaccaggcaaaaaacctaaattctcccctgcttctacagctggtcttgtaagaacgattttctttacaatattattttttaaagcatcaacagcaaaaaccacagccaaatacgtttttcctgttcctgctggtccaatcccaaatacgacatcgtttctttttaaagcatagtagtactccttctgtcctaaagttttaggatatatcatcttgccacttgccgttttagtaattctaacattatataattcattaattctacttaaattatcttctttagctaatttcaatgcatagaccacatctctacgagtaatattgattcctttagaaatcagccccagcaaagcagcaatcacgtttttagcttttttaaaattatcattattttctccagttaaacttagttcatcaccacgaagtgatatttctactcctaaagcttcttcaatcattttaaaattttcatcatgatttccacaaaaattatttaattgagctatactatattcttctaatttaacttgttctgtcatttaattctcctcttttgttgcaatatcttcaattaatatatattgcatttttaatactctcttgccatcaattataccataagataaaactttttctctatctattttatcaatagtacctaatttagcacgaattgtatataataaataactaaacccttcgccctcatccatttttttcttatcaatactcgcttcataatcaatataagtataagctttgatgattccttgagtctctattatcttatcaacttcactggtagaagtaattgtattagatactaataaatcgcctttttttacataatcattaacttttaccataatattgccgctgcttacatctatctcctgaattacaccatctttactagcatatatattttcaaaacttttttccatttttttagcactaacactattagtatatttaataaatagaacactgccttcttgatagatattcaaataatctatttttcctttaaatttttctttcatatcatcataaatatcattcaactgttcataagagcgttttttatcaccaataccaatatgattatcagataaaacctcatttactaattttgtcgtacttggattattcccaattatttctactctaaaaataaactgattgcataaaaagatagttaagataaaactaataactccaatcatactcaatttacgataaaacaataataataaataatataagattcctacactttttataactgttaaatgatattttctaacttgtattctttgataaataggaaggtaaaatcgatatgtaaaatcatcgattttatttaattgaaacactgttatacgatcatctttaaatgactttaataaagtaataatatcctctgtaactacttcatataaatcatatccaaatttcatataaaccttaagcagtcaatcttcccataaataataacttcttgatcactataatatctaatttctaaatctttacctgttactctaagaatattattcttcatctttatttcaataatgttattttctaacagcatcaaacactcataaaatttaattgataagcatttattttccatatatatcatcaaatcacctatctaattatatgatttatttttaactaaatgcgtttatttcaattaaattctcttacaaacaaaaaagggcttaaaagcccaaatttttttatcttttacctttgttgttttttcttgctgcttcagattttaattttctttttaaacctggtttaacataaaactctcttttacgagcttctgcaagggttcctgttctagaaacttgtcttttgaaacgacgtaaagcatcatctaaagattcattttctcttactacagtttttgccatcgaactattcccccctttaactctaaagtacgtacctattatatatatatttttcgttaattgcaagaaaaataaagaaaaagatgaggtaatgtttaaaattaaccacatttttgtcattatttaacattattcttctattttttcatccccctctaattcttttaataatttcatagcatacttataatatttcattttactggaatttaaatgaattgcataaccaatatcttttaatgcttcttcatattttaataatcgggacaatgtcattgagcggctataataataatcatctttttgcggtaataattcaattgccttatttttatcttctaatgcttcatgaaatctttttaatgtatgtaaaaagattcctcgactataataatattttgattcatggggaaataattttattgcttgatcaatttcctccaatgatttttcataatttttattttcaaattcttcccaactatgacgataatgaattttagcgttttgacgctctatatatgtatatatatcatctttttgaagtatatttttctgattagattgattattttttatctctaacgattcttttaacttattaaattcatcttgatatttttgacaccgtttttctgtttgaagcttcatatattcaaccggatcattaaaattcgcttcttcatgaaatttttcagcgatttgaaacattatctcatcaaagccatctatttctactaaactccctttgttttttcttacaacattatatactctttcatctggtttatcaccaacatagcaccagtaaataccttctttgcataaacctgattccttttccagtagcgacattaaagtatgatcaccacctgcataaccaataacaattggaatatattctttaagaacttttttcaaaacgccttcccaatttttcgctagagcgtccatatcttttcttctattcaaaggattgaaatataaactgcgatgaatcttagctactactggtcttttaaattcaccagaaatatatggcgctaaactttcatgacttactacttggggatgcttatccgtgtatattaatagagcatcttcaatcagcgaatcaaaattagtagttataactaaatgatttctcgtattcgcaagtaaaattgcaagtggaaaatagccataacttggtgttttaccttctaattcgttttccaaaaaagaatatccatcattcgttcttcccgcaaaacgtaaatcaaaaagatcaaaataatcatcatttttaatagtataatcttggttaaaaaaacgcttatatatatctctaccgtattggggatctaaatcatcagcacattcttttatatattcactgcctctttcatcagcccataaatactgatgtcacactttcatcaattgttcaccagtacgaatcccagaacttctagaagctcctgctcctaaaataaagcaatattttttacctgtcacactatagccttcatatatttgatctagaaatctatttaccatcataataatttctccctcgtatataattacttgattatagtaattatatcagattttaactatcttatcatctaataaaaatctctactttaatagtagagatctttattatactttcttaccgacaacttcagctatcttactgatttgttttaataacttctcatatttctctggtctcaatgactgtggtccatcacataacgccttttcaggatcgttatgcacttctatcatcaatccatctgctccacctgctactgatgcttttgccattggttccactaaccaccatttccctccagcgtgacttggatcgattacgattggtaaatgtgttagtttcttcactactggaatcgcttgtagatctaatgtgtttcttgtatagctttcaaacgttctgatccctctttcacataatattacgtttggattcccgctggccatgatatattctgccgacatgatccattcttcaaatgttgcacttaatcctctttttaataagatcggtttttttgtccctgctcctactttctttaataaatcaaagttttgcatatttcttgctccgatttgaatcaaatctactttttcattaaattcttcaagatactgtgcatccattaattctgaacagattggcagaccagttgcttttttagcagctaccaaaatatcaagtcctgaagatcccattccctggaatgcatatggtgaagttcttggtttgaaagctccaccgcgtaaaatattagctccggctgctttaacatctttagcaacttcaattacctgttcttcactttctaccgaacaaggccctgcgatcaacgctaaactttccccaccgactttaactcctgatacatcgataatcgtatcatctggatgaaatgcccgattcgctaatttatatggttctgatactttcataaccttttcaacacattcttctacttcaattgctttaggatcaattttagtcgtatcacctaccattccaatgattgtttgaatatcccctttagatacatgtggttgagctcctttagctacaattaaatttttaattttttcaataccttcatcacttgtgtgtggctttaaaacaataatcattttcttttcctcctataaataaacaaaaaactcgtcctaatcaaaggacgagataacttcgtggtaccacctttattcactaatagatcaccctatcagcctcatcaagtacgctatttattatatagttcatactctgacactttaacgggtgtaaccggagatgcctactcaattcaacattctactccttgatgtattcaactatttatttggataccgtcacaccagcccggtactctctttgcctaaatgcctagtctactatttcaattcatcgtatttaatctatagatttatgatactcattattcgtttaaatgtcaattaatttgctatttattttaaaataatcgttctaaaaattttcttacattactagcagcatcctcttggatttctataattcttgctcctctacttttagcaacttctcttaaatcaactgcaatcgctgtatgaaatgaacatccaattactaaaaatatatcatcaggttttaaactatataccatctcatatgctttttgataatttggagcaggatcaccatataatactggtttattatacaacgaccaggctatatccatttcatcatcttccggcaatccaccatgtaattctaatgcatcacttccagcaagcttatgtaacccatctatattcatagtaataattggaatattatactcttttaaagcataatgggcatcattaggctttgctccattcatattagcttttaattgtttgattacttcgttatattcctcgtgatgagtctgagcaaaatttctaaacaatttttctctaacttcaggcttttccatgaatgtaggaatattgctttgtttactaattcctgctcctgtaaaagctaaaatcttcatacatatccttctttctattgttaatattaaaatcttatatgatcagcatagcactttaattgaatttttcaaacaaaatcatcgctttatttttcaatatcaaagataattattttaaataattttatatcttttctgatttttttaatccatgaacattaatcacatgttctttttaacattttattttcatttattattgtactaaacaaaaataattaaaacattttataataatccctaatgattttttagataacgattatcataatataaacttacttttaaaaactccccatattaatcgacaccctaaagcataaaaagattgaattctattagcataaatatagatttcaatctttgatcatcgaataaaaactgataatacttcttactattaaaagttgattatccaacgttatcttgatcattttaataggtaattaaaataatcttaatttctgacatacgcttttaaaactttgatttcctcatctggatcttctggtctaattgtaaattgttttacacttgcaggaataataacagtctcaacataatgtaagacaaacggatcaaaggcatttataggactttcaatcactgcacttgttccttctaccagatttaacatattaactccatcatttgtttgatgaaaagtttttgtacgacttgttataactctggtttcaataaattctaattcatgtaatcctgttttaatttcggtatagtcatcattattttcaataagttcaaaatgattaactaaattatctttcacccatgttgttgtacgattccattgaatattctttttgccatcttcaatatgaatcggacggggaagaccatctaatcctagccggtcccaatcccaaagtttaaatgtaaaaatatatggtgtcgcactaacttccaaaaccatacaatttgctgatgaacaatgaactgttccagcgggaataagataatgatcatgtttttttgcttcaaaaaagttgatataacgttgtacattgaatgacccttcaccagcttgagctcgttttaattcattgatcatcttttctttttgaatatcttcctttaaccccaaaaagactccgccaccttcttgacaatccaaaatataatagctttcatcttgagtataggtcatcccaaaatgagatttaatatattcagttaaaggatgaacctgcaaacttaaattttgtccttccatagtatcaagaaaatcaaatctaatcggaaattctgctccaaaacgtgcaaaattcttttctcctaataaattttctggttgatattgaacaacattcatagctggtgtctcaataacaatatcgccatatttcaaataaaggctattctcttctggaacaccgtcaaaactccaggcaaagttatcttcatttgaatctaatccacatacttctttcatccactgtccaccccaaacaccaggatcaaaatatgggactaatctaaatggtcttcgacttatttgttttaaccctgctctaaaagcttcaccagaaatcatcttaggttgatcagccttatttgtatctaaataaaagtcaatttcatcatataaatcacgtttaagtttatcagctattctccattcaataaaaaaaccgcgtttatattttcttagaatatcttcatcattattatgacatttgaagtttggcattcctttacggtatcttaattgaatttcccatcttgccaaatctgcataaacgagaagatcaccttttgtaattaaacttgctccaacaccataaataaggcaaattccagcacaattactcacctgtgtttgaaatatgcttctttttttctcatcaataaaatccctcatttgtccatagtacattattcctcttacacgatcatctgttaaatgcatcgacatcatagaggttaatactgcctcatcatagaacatatcagcacttttaataacacgatcaggttttaatccctttattaatgctgttaatacttcttcatcgtttacacctggataacaatctacaactattatttttttatcacctaaatgttctaagattttctttgcaattgcttcatatccctcaatcccatcatcatatccaataatatttgtcaccggatacttatcataattcgattttctatttaaataacgcaaaatatcaccattcctttctttaagttttatttttaacctgtcaaaatttaacagccgtgccattgattattttaagttagctgaatttttcatactatatttttagttctaatattattacaacgtacttaactaataataatcgataaaattataccatttttttaacgaattattttaaatattttcaaataaaacatcaataaataaactagttaaatgacctcagcttttatttattaaaaccacatttaaatatagtgatatttatctttctttttgataaagaaaaacaacgtaataattaaagcaagtacttcagcaataactacagatagccaaattccatctaatcctaatataagcggtaaaaacaaaacaacaataatttgaaaaaccagcgttcttaaaaacgctaaaatagctgaaatcaagccatcccctaatgctgtaaaaaatcctgaaccccaaatattaaagccactaagcaaaaaagaaaaagcatacagtctaaatccatgacatgtcatatcaaataatttttgatcatatgcaacaaagatctttgctaatggtgaagcaaaaatttcagctaaccctgtcatcataactccagttagagcaataattattaaactttttttaaaaagattttttaattcattatcattttttgcaccataatgatagccaattatcggagctgtccctattgaataaccaatataaatagctgaaaaaacaaaacttgcatacataattaccccataagccgcaattccattttctcctgcaattttcattagctgaaaattgtataaaatattaattattgaagcagatatattggtcattaattctgacgaaccattggtacaggcttttaataaaatccgtttataaaaccttgtcttcaccagttgtaaaagactattgttctctttgataaaataaacaattgacatgattgccccgataaactgcccaaatatcgttgcaatccccgctccagcaagtccccatttaaaaaccactacaaataaataatctaaaataacatttgtcattcctgaaacaagtgatactttcaaactcatttccggcttttgcgctgtcacaaaaaaactctgaaaaataatttgtaacataaatgcagttattccagccgctaagattcgtccataaataatacaatctaaaagcatctgcgcactagccccgagcattaaagcaatgggtttcataaaaataattgcagttattgaaacaatgatgcctatcactgccacaacataaataatcattgaaaaatattcttgtgctttttgttttttcccctcacctaatgtaattgcaactacagcactgccacctgttcctaacataaaaccaacagttgaaatcgccatcataaaaggatacatcatatttaatgctgcaaatggtattttccctacaaaattggaaacaaataagccatcaacaatactataaatagatgtcaatatcatcattgcaatcgagggaatagtaaaacgaaataatctttgaaatgtgaaatgatcagataattgtattttcataattgcgtaaccttttctttaaaaaatgttaaatatttttttgtcaatcttactaattctcgtctttcttcaatgtccatttcctcaaaggctgcgttttccattaatgcaattggcatgatttttttattcaacaattcatgaccatatgatgttaaataaattcttttatctttttttacttgtttaatatagattacatcatctttttctaactttttgattgctgaatgaattgtctgtttactaattgcgcacatttgacaaatatctttttgtaaacatccctcaccattttccaatagaaaaaataaaataaaaaaagcactgtctgataagccgatttgtaaagcaatctcatgataaaaattatctgcttctcgatataagcaaaaatattcttttaattcttgattctgtttaaacatactgcctcctcatagtctgaaatcatacttatatattagtatgatttaggactatagtcaatatcatataaaattaaaacagcttatgttgtaaagtataagctgttttaaactaattatatccaaaaaataattttctacttattaaattatttgtattgatccaataattgaaagaatcgtaaaaatcaaaatcaatattcccgcccagtttttaaaataatttgtcaccttaaattcaattttatatttgctgccatttctgtattctctaataatcaaaataatagcagttattattacaataataattattgcattcaaaaatatttgaaaaagtgcattattgatatccgccaattgagcaaccgcattatttattatatgaattgaaattgctggaacaatagaattgctttttaatgttaattgacataaaaacagtgatgttacaaaagctggtattgtttgaggcaaattcccatgtaaaagcccaaataaaatcgatacaacaacaatcgcaaatacatttccatattgttttaacttacctaacataattcctctaaataataattcttcggttattggagcaacaataatcgtactaatacataaaaaaatattcgttacaagatcatatttagccaaaaattctggagtatcaaatattataactcctgataatagctccatgatataccctataatcatactagcaagccacgcggctcctaatgtcattactacaaatttcaaataagttaaaacatcaaaattttcatctgttttataagatatttttaaagaaaattttttttgataacgttttattacataatatgttgctacacatgacgaaacaatgagtgaaaaataagtggtaagatcttgatcaaatctcatcgctaacataattaccccaataatcaatgctagtatttctgccaacagcatctgtataataaccatcacactcaaactcttggcatcttctttaaagtttatctgttcatccatatcccaaattctcctatatttatatatttaatatcataatatcatgatattaaatatatatcaacaaattgcaaataatctaaatcttttatactataaaagaaaaattgacaaagtattgatttaaaaaattaactttgtcaacattctaataacccaatgctatttttttaaatattcacatacacgccttaaatcttctcgaataggcagatgctgtgggcacattttttcacatgaaccacattttttacaattttctgctttcttttctaccggcatgttttcaagattttcttttgatttatgatgttgattataaacataagcattattccaatgtttaaaattagcagggatatcaaccccaaaaggacaaggcatacaataaccacagccagtacagccattttgcgttcgtgatttcaacgtatccttaacattttgaattaaaaccagttcatcttcatttagatatctaaaattttcaaatgtttctaaattattgataacctgttcataagttgacattccacttaaaacaaccttaacatttggcaaactagctacatatcgaagtgcccatgatgatatactagcttcagaatcataatttttaaacttttctgtgatatcttctggtaaatttgctaatgccccgcctttaattggttccattacaattaaaggaatattatatttttctgttaatagatatcctttcattcctgcttgaatatccatatctaaatagtttaactgtaattgacaaaaatcccaatcatgatattctaaaatttctttaaaaacaggatattcatcatgaaaactaaatccaaaataacgaatttttccttcatctctaaatctttcacataaatctaaaatatcatattctaatactttcgcccacttatccctatctaaagcatgtaataaataaaaatcaacatagtcaacatctagcctttttaattgatctaaaaatattttttcagcttcctctttactagaaacattccaaattggtagtttagtagctaaaaagaaatcttcccgattatatttctttagaaccttgcctacaaatggctcactatcaccattatggtaagggaaagctgtgtcaatataacttacaccagatgtaatcgccttatcaatcattttttcagcttcattttcatcaatattaccatcttcattcaaaggaaaacgcatacatccaaaacctaataacgatggttcaattcccaatttttcaaatcttttctttttcattttttcttcctccacattcctacacaatattattatactgctgaaataacatttttactataattaaatattcttaagaaactactatattatcatatggtattatatagatattagaggtgttttaaatgaaaaaaaattgtatattatttgactctactttaattattttatcaatattatcaataggatactttatactcgttattgcaaattcgcgttttattccagcatatctcgcttacccaatattttcttttatcactggattttacggcagctatgaactaaaaacacattttagtattttatctaaattaccacttaaattaaattatatcattaaaggaatcggaatttttagtttatccatatttataataatcgaaggatcaataatacacgaaataagtaatcaatataatgaagcaagcgattatataatcgtattaggagcccgcttgaatggcagtactccatctaattcattaaaatatcgattagatgctgccattgattaccatcagacatttccaacaacaccaattattgttagtggcggtcgcggtaatggtgaagaaatcagcgaagccaaagcaatgaaaaaatatcttgttgataaaggtattaatgaaagtttaattattgaagaagataaaagtacaaatacaaacgaaaatatcatttatagtaaaaaaattattgattcattaaataagagcaactacagtgtgacgatcataacaaacggctttcattgttatcgaagcaaactgcttgcaaacaagcataatttaactgctcatacatatagtgctaaagaaaacttatatacagcaccacattattacataagagaattttttggttgtctaaaagacatcatattatcttaaatattccaaaaaaatcacataattgtttatatttattatagtattctataaatggaggaataaaatatgtttagtaaattatatattacaattaaatccgataatgaatttgatgacagtattatcgatcctatttcttttattttaatcgattggggagttgatggtaatttaattgattgggatatatatccaaatcgagcaaaattagaaattagcacagacgataggaattataaatcatatagtattacttaccagggaatgaattctattatggaattatgttataaagatgaatttgtaatgactataattgataataacggcccatcagaaacatatacaatgtattttagcgaacctaactcaattaactttgctactgatatatctgaactaatagattaaaatattcccgaattgcaagcagagagtggaaataagataaaaaagttctaatttttatagaaaatcgtatttttagttataccaattttagccagttctttgacaaatagctgttctgcaggaagataaccaagtatcttccttttcttttgattgattttttgattaatatctaatgttttttctttatctattgtattaatatcagttcctttctttataaaatatcttataagtccattgcagttttcatttgatgccctatcacatgaatgatatggtctcccaaaataaatctttgtacgctgttcttttgatcctggtttcttttccatatccttccatctggcaaattcatttccattatcgaatgtaatggatctgaatattttcttaaaatcgtcaccataaaatttatgaagcttattgatctgcatataaacttttttagaagattttgatgtaataggaatcatataataaaatcttgtttttctttcaatcagggtcaaataggcaccattttgtccatctcttggaccagtgacaagatcaccttcccagtgaccaaattcctctcttgtatcaacgctttcaggtctttccatgatagaagttcccttctgtcttttagggatataagttttccagttctttttcgtctttcttcttagcattctaggcagatcaattggttttatcgaaacttttccttcgtgtatgtaattatagaaagtcttagtagaaacagttaccatatttttaattttatctttttcatgaaggcgaagataattgatagtctcatcaacagaggaaagtctatttgatttcatttcattttcaacgagagtgataaaatcatgagccttatgaagtttagaattgttaggggtcttatggatcttagatcttttttcaaaggcagccaaagcagaaagttcagtacgttcattaagataggtatctctaacagtgatagtggcatccttaatgatagaatagacattagagacagaagtaccaacagaaacagccaaataatgaatgaattgagttttaccgatattacgcttatgaccagaatgcagagcgttaaaacgaataagttcattaacaataaattcataatgaaaaaactgaaggtgtttatttttagatttttgtgatatagtataagtgttcatagagagtctcctttattaggttttggtcgactaaaataatacgacttctatgaacatttttcatgtaaaaaattaaaaattgagactagagggagttggcggcgaaatgtaatgattggctagccaatcattacattaccttaattccagtttcattttacaatacacaagattaaaatattttaatttttttatattttctctttacatttgataaaatattagatataatcattcttgcgttaagccctaatagcttaatgatgaatatatggcggacgtggtgaagtggttaacacaccagattgtggctctggcattcgtgggttcgatccccatcgtccgccccattttttaacaatctagtctattaaccactttgaggttttatatatttttataattatacaactttatggcactatcatctttcataaaagtattttgatagtaatatgcccagttgacggttaaaagacagtattgaattagattattctatttgttataatattaatcgaaattaaaaattataacaaatcgatataatcggttacaaatttcgtagtcatttttctgtcaactgacatacgtaacaaagtttctatagtgtgaagaaactttgttttttatttacttgtatttattataacattgaaaaatgcaaaaataaagtgataaaacaaattttcatctatcatagcaattttaacaataatcacataatttcacattttattttaaaaatgaacagttttaaaggtggcaattttgccacctttaatattatatctttcttttttgttgcctttttacaaaatcatatacttcttttatttcataaacctgtttatcatcatatgctggattagttaaactggatagcaaaaatttttctaatttttgaataaagtttccatagctgctgttttttttattttctactgcattttctaactgaactgctagttctttttgtgcttttgaattaccatgcaaataaagttctgttatctcgattgaatcatgacctaatcttttagaaacattgtataaatcattagttatagataacatcattgttgcgtgactgtgtcgaaaaccatgcaaattcatattagtactgtttgaattaattttatattttttaaaattacgatccaatgttgtaaaactgatcatgttaattccaccaaaaacaaaatgattattaatatttttattatatacagattttacattcacataataatttaatataagctctttcaatgatttatttatataaattgtccgataagagtttacagtttttggagatttaactatttgtccaactcctgaaactttacatgcagtactgtttattgtaatagtctcttctaacaaatctacgttctgccaacgtaatgataaaacctctccttttcttaatccacaaaagaacagaacattgaataataccacatacttttcatcatcaacatatttaataaaattattaaactcatctagattccagatgatctgcttatcttctttaaatttattcttgtcaacagcatctttaattgtttcaaaacctctaatttcttcaatgctcatatcaacataccgcattagattagcatacgtcatcaagcgttttaaaagtttaacaattatattggcgtatgatacggagtatttctttttatcgctagttgtgaacactccatctaaaaaatttttttgaaatttttttaccttaataaatgttatttcttctaatttacagtttccaaatacctcccttatgtgtgaattatacctatagcagatagaatctatcgtagtatcctgatgtgttaaatcgatatcttctaggtatttaataaataattcgtttaatgtcataaattttctccttttttagtgtaaaaaaaaactagttcaagcagttaagtgcttgaactagtccatatattacactatacagttttataatcaggaagttttttactgtcgtaatcccttatccgttcaaaatgaagtgttccatccgaatccaaaatcttatcaaataaattcatttcaacgccttcaggaggagttgaaattgaatcgactctattataacgataccatagctgatgttttttttgataagcctgcgtacatcgatgatcaaaatttttacaatccactttacatactacaaatgaattgggacgatattttaatattgtagcatcatcccaattcataatttcctcaactcttcctactctaaaatcatttgtacgatttcttctaaacgtctttctagtaacttcaactactacataatcacctttttcaatatccttgattggacatataaacgcatagggtttactattttcatttatttttccttttaatcctctacgcattttaataattactattctcaatgccataaattttcttcctctttcctgtaaatttctttatataataatctaacctattaaaaaaaacttcatcaaaatctactatttttgtaataaaagcagcttcaaattaaaacatttagatatttaataacaaacttttttatttagtacatattttctcaaaactctcaattgtttcttttgcattaatgacaacagtattcagtatttttaaaacttcatatctattttcattatttatatattttcttactctcctaattaagacgtctgctttatttaattcttctataatgttcttttcatctaaattcattgttaataaccctttcttttatgctacaattatgatcaagttctactaacctatataattttcagcattgttcaataactgaatttcatttatatgatacatctcaattatactttttttgaaatagtatatttttaatatagtaaaatggtggcaattttgccaccatttaattatcctagttcaatttttttatctttaattgatatattattctttgtttgagctattgttttttctttagctgaagaaattctatgtgaaagtgatttattattttttctaatttgcatatcattttctaaaccatcaaatttttcaatcatctcatttgttttttgatacattttagtactagtttccataactttaaataatttatcctgaatcttagcacagattcctacatcagtatctctgctactaatttcttttgtttcttttccaatcacactacgaccaaaattagctaaatgttcttttgattcatgacttcgattagctaaattacttagcttatcaattcctttatcagcagtattagtaatactactaaaattgttcgaaaatatttgcagtatatcttttacttttatttttttcatagcagatatcagagcatctttcccttttatcttaacatctttaattaatttatcagctatatcaattatactatttttaatatctgtaagtgatttttttccattattaatttttgtattaatatcattaatgatggaagcagtttgtgatctttcattactattttttatcttttggaattcttgattcatttcacccattttaataagaagatcttcatatttcttttcagcattatcaacatagtcaactataaattgtaaagtgtttttttctgctttcataccataatcatcaagagtttgaaataactctctaattgaatcataattttttattgatgtattttccatatttttctcctgtttaaccaatattatattctatttttttattcttatttaatttatttgttactagttctttacttttttctactgcattattttttctttgagatagtgaaagtttttttttagatatttctattagatcctcattccaatccttaaaatagctaaattcttttgttatattgttacctaactttaaatctttaattgatttttctaatatattacctaattcctttcctgcttgatcgttatcaaagcaaattactaaatcattttttgatttattttctatataaaagttttctacacacttatatttattagcagaaccacatgcaataaaaatatctttatcatgattgttgcctttttgtttttctaaactcatataggacaacatatctatatatccttcaaaacagtaaactttactatcttcaaatattacttttttattatcttgctctggataaattcgccagccaatatcgtagttacacccttttaaatctcctttgaattttgaattactacttatccctctaagtgaaatggctgaaagcagcccataattatatccaataaaggcaactgcctttgatccattaggagtaattgcttgacatattctttttttattaagttcattataaacaatagctttatcaatttttcttgtatttaataaatatgcaataacatttctattattgctgtcttttttcaaattctttaaaagactttcatgactatcttttatcctattaattttttcttcttgactcaaatctgaatataatttctttttttgatactgttgttcaattttaaaatttggatcgattttatttttcaaaaaattcactgcatcagtaaaattatcaattccttctatttgagtttctataacaaaattaataacatcaccaccatgacgatttgaatttctaaaaaaagaattagtagcaggataaataacaatagaactaaaatcaccgttttgaattgaagccccattttttattcctaaatatccattctttttggttacatcaaaatattcatttgcaagatctacaatattgactttagttttaatatcattaattatcttttttgaaaaagctataataatcaccccttacaaaaaaagtagcaatcatttttactactgtttactacttttttaaatgattttttatctaattttcttattgaatcgaatacatcttccaaaaacaactcttcaagtttattatttggctgaatattatttaaatttttatttgtgctaaatacagattgtgtattaaaactattgatcaacatttttgcttcattagtcattatttaatttccttccattattgctaaaattttagcatcattgattctttgctttaaattcctagaactgcgctgaataatcatttctttcttttcttcttcataaactacatttttaactcttgttaattcgttcaaaaaatatttaggtaaagaatggattaatatataaatatcatgaataaaaatcaaaatatctaaatcattacttaatttcttactgttaaattcaaattgattattaaatctacacactcctgtcaaactataaaaaactatttcttttatataatttaattcttcaaaactatatttttttagaatatctttttgagtctttacataattattaaaaaataaatctggactaagtaaaacattaatatagtattctatatcaacaatatcaccaccacattcatctgcgattttgattgatggaataatattataatcatgaagatttaccatttgctttacatcaaacacattgattttttgccattttaacgatgagtttgaaccatttaaattgggtatatatactttacttgcttttgtacctgctttaggtactattttaatttctaattgattattttctaatacaattaaattccatttttcaacagtatttacataagtagcatctatgttggtgcttaatatacttaatacattaaaccactcaactttgtaattatttaaaaaaaagtgtgttaacgatctaaaaaattttcttctgatattaacatcatcattaaatatactattcctagcaaatcgttcaatattttcaataaattctttatccatctattctatctttctgctttagattgaattgaaatttcaatatttttttctttatctaaagcattttcttttacatttttaaccttctcatgtttttttatactgtagagtttcattagttcttcagcgctcactataacagattcaggcttatcaaaaggaactttaccatctaatggtgcttcacctgtaggacgacccacaaaatgaatcttgtactgtcttttttcatcaagataagtatacattcttccctcttttaccttgtctttaaaaacagcattatttggtaaatttatataggctcttcgttcatcacgatcgataccatttttatctataccaaaagaaacatctctaaaatcttttgatggtatataaattttacacattttcaaaggattaccatctttatccttatatgtccggtgattactaatttcacctttttgtttttcactaaaattaatcgcaaataacctttttttcatcttttctgtacctttctttatatttttattaaataaaaaaaccatgcaaaatgcacggtatgggagagggaggtagggataaagctcttattgggtgggatttcccaaaaagataactccctaactctcaagcatattatctcatattatgatatacaaaaatataggacttttttctacacccttttaaactcctattaaactttttgaccaagaccccgtttgaaaaagagcaataactactaatactgtataaccaaatccttcatataatgcattcataggattgctagaatctattgtaggcatagatcctttcataagaagaccatacatatataaaaccaaaactataaatataacgtgcaatgccaaagcacacatccttttgataaaatttttaccaataacaccatattcctgactcgccaatgtagcaaatggaattgcagctactccagtaaatacatatatttcaataaatcttaatttaactattacttctgcaagaattctagctataccagcaccaaaacttaatatcatagaagtaataaaatatcccatcaaagttaatgtgctacactttgataatgcatctcccatttcagaagccgaaatatcacctaattcagataatgtaaaagatgaattagatacaatttctgctgaaatttcaaatatagcatcaattattaccgtcatattttccataataatttttgaaaacataatttttaatagtatctgacaaatccaatatatacattccattccttttacatctgctcttttaaataagctggctaattctaacaaaagaaacaatgataaaatactccatgcaataggtaatactgcatttttattaaatgatacaaccgcatcccatatttctttattaaaagcacttggggacatgatagcagtattatatacagatgaaaaatttgtaaacattgatgaaaaagtattaataataaactccgaaattccttcttctagccaatcaaacataaaatacctccaatctaaaagtggcaattttgccacctagtattttttcccaggaatcaatgcaccatgaatatactctagatgcatgtaatcctttttatttttataattaccaccccatctaaatccatattttatccaaatattagcgacttcttgcgtaatagacaaatgattagcacctgttgcatcataatcatttgctgaacctgtatcatatccactacttccaatttgtggattttctttaacattaatatcaaaagctagaccaaaagaatgatttgaaatagctccatttccaccagctatctctcgccatgttccaccacatgtattatcatatgctctaaatcctatatctaccatttcttgatatatttttaaaactgtacctgcgagtgctttatgtactttaaccgtagcaaccgacggatttccttctctattcaatataggcacttgtagattaatcatatacatttctgcttcttctttattttttggaacaccattaggatataaatatcttgctttttcaatggtagtcccagtatttaaatcaccatatgtaaaacctgaaagctcatttatataatcactataaagctttgaattataattttttgatgaacgtgctttttcctttaagttctctatactactatcaaagccatagctttctctttcactacctacatgtaatttagaatatgttggaaaaacatcaaaataccattctttattaattttcttttggtaatcataaccataagtacccacatcatatatatttgtatcaatcccccactcttctgtatttaaaagattaagagcaggattattgtttttaaatacacgttctaatgcagtctcaaaatcagtatcagtaccttcagtatctttatgtggatctatgcaatagatataagaacataaccgatcatacatttcataactaccttcataccaatctaaagcgtaagtaattgacatcatatcaataatgttgatattaacattgtatttttgttcaaggacatctttgtattcaaataaaccatcaactcgcccataaaaattgtaacttgaaaaaatactcataattaaacatataacaactagtataatcattgctggtattgatgtaacaacgcctacgataattgcaggtatactagtaacaaaagtaactattccaattattagtgatttaataaatctagtaacattaactactgcttgacgtgcctgttttctatattttaaagttgcccagctgcctttaatgatttttccagcagctttagttgccacatcttcattataagcgactgcattaattccctttcgactttgattcgatacagtatgtcttattgagcgttttaatgaaaattgtccttcagggttgattttcctctcatttctttttgctaaaaaattaagattatgtctacgataaaaatttactttatgctttctaataaaatccaatcctgattttccaattcttttagtatttctagcaaccatgaattgattaccaatcaatgctttagtaaaatgcgctgaactatctccatgagctttatcatataaatctggtgttctttcaacaattaatcttccagttgtttgtagagtacggtgtttaggagaatttatgttatgcactgtattatgtgtagttctgtattttgcttttacctttctattgtatgacataactttccttataataagatggtagcaaaattgccaccattacacattcaaattctccgttttctttctaagagctgttctttcatcaaaatcgcttgttagaacctcataaataggattattttttggaaaatcgtctttaaatggtataattgcatttccacaaagcattagaccactacctctttttgcatttgtaattgaagaaagcatctgatttgataagttcaatatatctgcaagctcatctcgatctgttgaagcctgatccaacattacaataaaattagagtttgctagcattgtcctaattttttcatcatgtattaagtcttcaacattttgtgtaatcccagttaaaatagcaccatatttaggagcacgtttccatagaatataaaaaaattcgacacaatatctattaaagaacaacaaataaatttcatctatatatatccatgtacgcttacctttaagaaaatttctctttactcttacccataatgtttctaaaataaccatcattgctaaagatttgagaccttcacttaaatctttaatagcaaaattggtaaaccgactatatatattatctgtagatatctttgaaaacatattatatgttccatcattaatataaattccaagtgattcatacatatcttgagctgttttttcaggttgtccttttaaaacaattgcaaagtcatctaatgtaggaaaaggtggaggttctatagtcataccatcttgaatctttcgtttgtattcatttaatgcctgttcataagttgcgaatgtaattcttagacttctatcaactacagatttttgtttcgcttctagaacatcataccctaaaatatttgctatgaaagactgcataaaatctgctttttcacttatgaagacaggatccataatatcaccttctagaagattaaaatacatcgtactttgtgaatcaactctattatttgtacctttatacctgcaacataactcttcatattcgttttcaggatcaataacaataatgtcatcaatagtattcaggaatagttgaacaatttctcttttaacagcaaaacttttcccagatcgtggttttgctaaataccagccacttgcatttggtaatattttcctactcgtaagtatcaaattattagttgttggattcattccataatagcaactagagtcaccaggtttcagtagctcctgacttgtaaaaggaatcatagcaccacacaccggcgtagttaaagttcttcctttgccaccaggacccgcataaacatcagttttacctaatggcaggcaagcattcatacatttttcttgctgataatttaaagctatcatctctgttgaatgttttttagcccttgtaagaaccttttttgttatttcttcaagttctatttcagtttctgcattaatcattacaaaaaattgacaaataaacaatctttgatttctacgttgtacatcttctaatagctcatatgcactttctaacgaatatttcaattcagctggaatcatttctggatcatatccatccttaagcgcttttctttgctcttccattttttgcatttccatacttgctatatttgttttaatcataggaatttcatcttccctaggaaacgttttcatatgaaaagaaataacaagattatgttcaattcttgtcagatcatttataaatttatcagacatttctgttgaataatttttaagccataaaactctgcaaaatctattatctatttcaaaactgtcttttttagaaaaattaaaagatgtgggtgctatagcatctttcgttataaatgttggattaacatttgaataatcaaaaaagaatttgccaccaggattaaatattgtataaatttgttccaaacggtcttttccattcataacatttacatcacagcctaattctttaaatttttcttgaaattcttgtgtttgatattgaagatcttttttagcttcatcaatattttcattttttgatgtaaatataaacattttatctgttttaatattatttgttccttttgataaattatttttaattactttattaaaatttcttctatcctcatcaaattcatcgcctttatctttcatcatgatttgttcttcaaaatcttctttatctacttgatgattatgtattaataactgtatccctgtctctgtgcctaacgaattaagaatctccatatattttaaccaaattgattcttgatcttcctgacgtgcaatttgataattaacatctgtaaattgtattgcggcactataaagatcatcacctaaataacaaataccatcttgcatcattgcctcataggcaatcgcgttttgcgtagttcttttaatttttcgaatggaacgattagatttctttgattttattcctttttgttctttttttctttttaaaatcactatacttatccccctttctaaaaaaacgaatctcattatcataaagtaacttttgaatatgtaatacattaaataaaataatattcatgtaaatatcaaatggtatatcctgaattttaacaaatccacataaaaaacaaggtataacaatcatcataataatatatgacaaaatatcactactaaaaaaaggaattagtaacagataaataattatcgctaaactaattccaataacaagccatacaagctgacgtaaagttaaatttttaaagatttttttctcatattcttttatttcctttggaacaggaacatatatcatcttttatacctccaatttaaaaggtggcaattttgccaccttaaaatgttattaaactaattaatccagcagcagtaacaaccattgctccacctacgatttgtccaattccctgtttaatatcaggtgcagttttatcctttaaacctgttgccaaaacgatcaatccccatactatccaaaatattccaaaagctaaaatacctttttgagtaatatctaaaacctgattaaatgcttccattaatatatacccttaacactaatttaagtgttcctttctgctaaaatttaacgacaatcaactgttattacatcgtcgaaatcaatgtttaaatcaaaaagtgaattttctgttaattctgactcctcatcactttcatcattttgtaacttcgccaaatctaaaatatgaataatttcatcatccgttaaaagattttttgaatcagcatttgctgtcaaattaaaattcttgtgatttaaaggattaaattttttatctctaaaaacatgttgtcctcttatcattactaaacattcatcacgatctaatctacccatttcagcaggatcaattaaagatcgttgaattaaattattggatttcgaaacactagaattacttcctttggtttcagaaatatttaaataatcatatgtagcattacctatcattttcgacaaatattcccaagtcgaataatcttttccacctaaaaacaatgtcgtatcacagcatccaaaaactgtttcccaagattccttataattttttttaagttgtgctaaatcctgaagaataacattaactgagatttcacgtgagcgcattgttgctattttgatttcaaaatctggaattttaccaatatttgcaaattcatctaacataaatctagtatgaataggtaatttatgttcacttgttgaatctgcctgaatgtacagcaaatcaaaaagttgttgatacattattgctgcaataaaattaagagtcgcatctgaatcagacacacctataaacattgctgtttttttcaagtttccctgactatctttttttggatttccaattgtatataaatcaatcgtatcgtcatcaagtagttcatgtagttctggaaggttgaaaattgacattcgtacacctacagatataagtacacttttagctgttttaccagttgctttcttgaataaattatattgaaggcaagctaaataagcataactatttttatgtaaatacctactttctcccatttcattcattaatgttttattctcttcatccagttcttcaaacatgaaatcaagtggcgacttcatattttcgtcctcttcagatgcttgagccaagtccaataactccataatactagatatattttgttcctcaggactagcaactgccataataaagaaagttattgccgataaaaaagttatttcagctttttcaaaaaatggatcagcagttgaattaatatttttatcatttgtatttgcaataagattacttatgaatttataaacatcaagaggtttatttacatacttcaatggattataatgcatactattatctatatgaattaaatccaatatttttatatcataattgttttgaagtaatgcttttccgacttctggaagcaaagataattttggatcagtaattatataattacatgacatacttaatatatttggctcattaaagtaaaatgttttaccagagcccgaaccaccaacaatacacacattattatttagaaaagttaaacgtgtattcatcgacaatctcatattttgcgagagaataatattatttttttcatctgtatctcttaaagggttaccctcattttttatatcaccatagcgagccgaaccatgttcctcaccacttcgatagtttcttcttgatgatttataatacaacacaataagcattactatacatacacttaataaaccccacaatattgaaaaaatatctattccaatagaaatccctaaaattgataatgaatagctttttattatgccatttaatgtttctaatatcggaaattctttaccttgtgaacataaaaattgataatataatgataaacgattaccgattaaaaaagcacatattcctaaaataatattaaatttattttttttcaaaaattccattagtttcaaattggataatatattaaaatggtttctagaataattgcttttatacttgccacaatttgtaaaggatcgctattacaataaattttgtatccatcccatttttcactatcttcattgatagtttttattacatttccaaattttttccattcattaagcgtattattagaattatctattagaaaatcacatatgctaggacaaactatattttttgattttccataattgatataaactcttttttcgacagggatttcaggtatttgaaaatcaagccatttatttatctcgactttagcttcttcattaagaacagatgaaataatatatacatctaccccttcatttactaattctttgagagcttctatcatattttcatacggaagaatatttttaaagtaatctaccataaatatatcctctattttctttattcttttaaatttagccaaagttccctctaaacctacaaatactctaatgtttttcatgctcatctttgccttttgttattttttttaattctttaaacccaataattacaaaacctatagcaattataacaataatgataatagcgtcttccacattatgctcctccttttatcttgatatcattttttctttttgatttctattaattaatctgtctgctttttgttttgcttttagttttcgccgtctaagatccatacatttttgttctgtatctctagcaatatcatttacaatgtttagatcactagatttaaacattacacttacactgtcttgataagtttcaacaactttattctgttctaatttgcaaaatgcatttatatattcctgttctttgagagttaattgatctttatcattattatatttttcaacaagatcatctatatttttaggacatttttcaagatagacatcaacacctctatttttacatagcttaagaaaaatcttcatttgtttatcattatttctaataacatctttagcaaattcaacatttctattagcggtttttgatttaagaataaattgctctttattcttaaatctctttccttttacatctctatagttatgtgtctttgaccaattccgcaatgtattcaaaccattcttcaattgatcagtaaaatcacttgttatactaaaaatcattcttattcctatttgacttaaatttttaatttcctgttcaccgttcatttatgcttgttaacccttctttcatagttatttattttttgttcaataatttttttctcgataatataaagaattgacaatataataattataaaaattaaattaactgtattttgaataattataagaactacaaaattgatccaataattttgaaccaatggtgtatagctaacaataacagcaaaaatccatatagttactattgttattgcaatatataaataatattttctagctttaatttcgatttcatttttcataatttttctcttctttctttggagctctttcttctggtgtatctcctggaatatctacaccatctaaatctctccctgtcattaaagctaattctaagtcacgatagttcaaattattaccatttaaatcgtcccctaaatcaaaatatttttcaataatgtatgctgcttccctatttaattcctcttcatttaaattaactaatctatttctatagtcgcgttcattattgttcttatcaagaactctttgaacatcagaaggttttaatactaaagcaatattgtcatttttatcatgaaattcatatacattagaaatttcattatattcaatttttaattttctataatacatcataagtaatctaattgtttcattattcatactattttttacctttcgttacatattaataaaaggagggaaaatttgccacctatctaaaattaacttgaaatccttcaccagtaggactaacactataaccatttacttttccattattaaatatgctttcagcatatttaagtgcctgattataaacatcaatagaattaccactaaaaaacttattataaatactagcatcctgtttttcttccttatctttatttaattcatcactacctctttttgtatcacttcttacttgatttttattatttttttcttgagtttcatcttgaataaaatcttgcttattttctgctggtcggtcagttaatataaccttaatttttttagtagtgttatttccactactatcttctactgtaaattttaccgtataaacacccgatgtttgtttaatatcactcgtatctatataataatcaagattcgttgtaccactattatcagttacctcaaaatactcaagccagttgatagtattaatttcatcagtatatttttctactttttttactaacaattttacttcaggttttgaaatatcttttacatacacttttttcttgattatttgctcatttacattatttgtcttgtatgaaatttcataaacaccagaaacagaagtatcaatttcattactacattcaataacaaaatttttataaattatttttttgttatcaataatatctctttcatttatcacttcatcattaatttttgaaattaatgaaataggataatcgttagaatttaaatctaaaatcatctcttttgaaaaagtaacaatataatctgttttattagtacatcctgaaataaccaagaaaacaataacaattaaaataatttttttcataataaataaattaaaggtggcagatttgccacctttaacctcctattgactaacttttttctttctaacaagtgaaataactacaatacctagtaatgtaatataaccaagacataaataattattaatagaaatatcatctccagtctttactttagcaattggcatcaattcatcatacattactacactttgtacatttcctgtatcatcaacagtaaattcaatactttgagctacttgatatccatcaggcgcaattgtttctgtcaaagtataagtctttcctacatatagacccttgatcatatgtgcctcttcaccagaaatccagctgtctacgatattcccttcttcatcactcacctgtagatgcgctcccggtaattcttttgatgttgtgatatctaatttagaaatctcaattttcgttatttcatctaccatcttcaatacaatatctttattatcaacttttagatcctgagtagctgcagttgcatagccttttggtgcttccacttctttaagtaagtactcatcactttgatttaatcctcttactaaatgactggtttcattaccttcaatatcgatacgataatattctgtttcaccattagactgcagcatcaatgtataatctttggcatctttatttggtgtgattctgtataatactgatgaatcttcttcatcaatatacatatcatttatggtctctcccttttgtaaaagtgacttcatttcttcacttatatcaataatatgtctgccgctgatccattcatcaacaatttcattcgtcttattattgatgacttgaagtctagccccttttaataaactaccttcctcatcttctttaatgacctgaacttgattatctgtcatttcaatcatttgatctttattatcatctacaactgtaaacatcatatcatctgcttttacatatccttttggtacattgatttcttttaaaatatatgtttcacctgcaagcagtcctcttacattatgatttccacctgcatcaactgtccactgatcgacaacatttttcgttttattcgatacgacctgtaacacggctccttctactgcttttccatttgcttcagcttttcttaccgttacaactttatcgatcatctggactttttgaatatctgtggtactggctacagtaaatttaatttctttagcctgaacatatcccagtggtgcaagatcttctttcaatgtataagttttccctatactaagtccctgaatgcccatcgcattttcacctgaaatccactctgcaatgatatttccttcatcgtcactaacactcatcttagctcctggtaattcagcttcaccagtaacatcagttttacttatttcaacgattgttggttcattcacaagttctttagtaacattataaactttagtagttagatctgtctgttcaaatttgacttcatatttagtttcatctaatactacaccatctaatgtttcgatctcctgcagttcatatattcccatcggcagatcagataccttcaagtatccactgcgatctaaattatattctcctacaagagctcctttggcataaatgatactgccatcagccatatctaagatatcttctttagctgtcaatctaaacttgatcttacttagatcagatctgtcaacaaaatcatatccatcacctaaatgcgctctttctaaagaattaggtactgccaatattccatatgatacatctttatatacttccaattctcctaccggcttatcatttttaatgactacttcaagaattggatcaccatcaggatctttatcataatctctgatgttttcaacatcaaattcaactctaccttctaatgataaataaccggtcggtgtctttatttcatcgatatagtatttaccggcatctaactgtaacggtaaaactattgtacctttatcactgtcattaacattgtaagaccctgatgggatcactacattatctgcagatgtcgtaaaactatcataagtcttaccgccaactttttgtttgatcgtttctccggctttataaatgatcttaccattagaaacaatatcttctctggcttttactttaaacgttgcactattcaaagtaacagtcttattgctgtcaagatcctttttaacaagtcttaactgggttgtataaggacgattattgatatcaatgatcttgatttgagcgatatcaggatattcactgtaatctttagtcactgatactgtaaaatcaggtgccgtgatataatccttaggtgtttttgtttcacgaactaaatattcaccataaggcagatacttagtattagcttgaccattttcatcagtagtaatgacatcgtatacttcagcattatcccagcctacatggtctacttcactttttaatttgaaagtaaattcagccccctgcaatcctttgacaataccgcttataccgtctttttcacctgatttatggatctggatcttttgcatattgacacgattatcagtattggtagagcgtagaactttagaaacagtctgtccttcatattcaatatcgacattgatatctttagaattcaacactaatgattcattgctcttgctttcttcgatataatatttaccgatatgcagatcatcaaatactaatttaccggcattatcagttgtctgagtatcgacaacatcacctttattaaaataagtaactgtaccagccttattagtaatatcttctcttgcgataagtttatactcattgccctgtaaataagcatcaccagacttgccgtcagttaaagcggtattgatctcttttgtcagtgaaacagaaccagtaggttcgttattttccactactttagaagtagtttcaccgacattgatagtaacttcatattctgtttcatcaaggagataaccatcaggagccaaaacttccttcaatttataagtaccggcaagcagattatcaactttgatcttaccatcagtgactgtaatattttcatcataaccatcaaaagatactgatttcaaattaaaaacagccccatcgatcaaatctttattagtattagttttagtaagttctaaagaaccgacttttaaccaattaacatttaattttaatctttgaggatctcttgtaaacgataatgttccttcactttgtgtgctagctgttccctcgattacaagaggtgcatatttaagcaaattatcagcagacaaagctccacttgaataatcatctaatgctttcattggcgcactcaaataaaaagtatcaccgccatttacagcaacagttccagtactaacagttccttttgtcacattatgcaattccacaccatcctgtaatggaatattgatggtagcagattcactagtatttaatgtgatatcctctgttctttgttttttacttgactcttcaaaatatgcattagtagtaaaatcatttgaaccattaaaagtcaatgtattagttggtagcggcatagactggatttgatcatatcttgttttcaaaccaacaccaatactggtcaaataatcccaggtattgccaccatatagatcaccactgtaagcataactagccatgatatgtgtaaataaatacttttccttatctgtcgacactgtatcatctttaaaaatatcagccggtccaccataaccgtaatataaaactttaagcaacgcttcattattatcgattacataaggtgcattgagattttctggaggtgtatccttactagcctctaaacagtacgctagatttccatcaatatagcacatcttcgtactccagttcccaagccagctgggatacatgatctcttcaccccatgtaaagctggctgtacctccatcagcactaactgcacttaaatttgtagatacaacactgaaaatcattgtcataacaatgatcaactgtctccaatttcgtattattttcttcatttatctaaccttttatttaattctcttaaattaaattcctttctgtttttattttttctatatagaaaaagcaaccttatgtggttgccgatttaataacatggatctctacaattgtatatgctcataatttttcccttcctattattttcaaaaataaaagcaatccatttaaatgaattgcctacttaattattgtactaccatattcagtataaccacccaaacattccccatgtccagcagcaacaagttcttcaagtgaattatattctccaccatgatcattacaagtatattttgtaactatctgtatacttcctcctgaagatccattattattcgtactaccgctagaagaacttcctgaattactgtttccacccgaagaattacccgaactaccgcttcctccagaacttgaattacctccacttgatgaattatttgtatttccactagaaggtttattagaactatgattactgctacttgaactaccagaatttgatgaaccattagtagttgtattttgttttggttttggtgttacaactgtttttttctgccctgtgactggatctgtttgaacttcactagttatctctacatttggatcagctgcagatgcaacaacaatgaccttaaattctttttcggttttgtttttactggcatcttcaatactaacttttgcactatactcaccaggtacatttacatcgatcatagcagtatcgatcgtataatcagataactgtgctaaatcagttgccatcattaatgatttaaaatcataagttgatagatcagtaccctgaactatttccaccctttcaggaactgttagttctggagcaactgtatcttttactttaatctttaccgttttactttcttttttataagttaaagttatttcatagttaccagctttagcatatcctttatctttttcacttgtcaaaccatcttcattagtaatgatttcaacttcgttactaatattggatttaagttttgtattttttaaaatttctgtttttttcttactgtctacctcatcaaaattcaaataatctttaggatcgcttgaaatcgcttgaccatattcaacaattacttcctctttctttaatttcaatacttctgattctgactttgttaaggcataaattgcaccagttgcaattataactactcctaatacaataccacctgcaagaatctttttcttttttgtattaaatattttctttatcctcatttttctcatccccttcatttttacattttaataataacatacatacgaatgcaagaatatagcttttttttctacacctatatagattaataaaatataaaatcttctaaaaaatcaattatcaaagaattaatatataaaatactttttataatcgtatttagcaatactccagtaaccgctccacaaatcactgtaatatatctataatcgtctgtaatttttccaaataaaatacctaatacatatattgctaccattatttttagtaaatatgaaataaaaaatgctaatgcaaatattcctgttcctaaaaattctataactttcataataaaatatagaataatagctaacggttttagcaataaatatttaaataatttcccaattatatacatgatcatttcctctccaaattatattttaaggtggcaaatttgccactatttttataatagataatattattatctatatcctgtcaaaacattataaaatttatttacatgtttttctaacaattttaaaaatacaatgagtaatattacaactaatactggtgtgactatataaacaattaaactattaatatcgttaataactataattttaaaaataattttttttaatattgttaaagaccactcatgaagcaaaaatattccaaaaacatattttgaatacttcataaaaattttatttttaattttaatcactattttaaaccaaaatacaatacttattaaaatctgcaattgatgtatatacatatttctagtaattaattctaaaataattactagaatatacattatacttaaacatgttaaattaactttctttgctgtgtttaaattaattttaaattttactatgtaatagcccatactaaagaaaaataaagattgatactgtaagaaaaatacatgaagattaaaattaactatccataaacaaaacataataataaataatatcttaggataatagtcaatcaatatttttatcatttttgataagatattcagaacaagcaaatctcttataaaccataatggaaaaaccattggatacatcggattgcctataaatgcatctatccaatcttttatattccactcctgtattatccagtctttattgacatagaaagatttagcaaaatcaaattgataggctactaaaaatattattatccatattaaatttaccaacaaatacggtattaataatgtttttgcttttttctttatattatctttccaagtaaaatctcttttatatagtaaaataccagctaacataaagaaaataggtacagcacaactagaaactatgctagatataaaatacttaaaatttattaaccatcctgcttctacaatattttcatgtattactatccctgcagaatgaatatataacaccataactattgctataatttttaatgtatctatagcttcggaatattcttttgaaattttataattcatttctttaatccttcttaatacaaattatttgaatttagataaattccaataagtgcatcatattgtaaattccgtagaatttgaatcatatttgactgactcacacttatacatcctactgttgatccgcctgtactacaatgtaaaaatatcgcagatccagcgtctggaatacaagcagtgttgtaattaatagcaatagcatatttatatgctgttgaataagaaaccaaatgttctgcactgttccactgtatcccagtttggctggcatcaaccagtctattgtaatatgaactgttaacatcatctacccaataatggttagaatttactgttaaccagtttctagatataccagggttgcttgctataccaaatgcttgcccaaaagaataaattcctgtaggtgttttcccatcgccttcacgtttattgctagttataccatttttccctactcgagctgaacagtttaatgtttctgtccagattccgttacgcttagtatgcagtgttaaagttgcatagcttccaccgtttccaacaactgttattgcctgtgtagtttgacgtgatatcgacatattagcaacaaaactttgattcacaccagaattagaagatgaattagaactgcttcctgctgaaactgtagatccttttttatttgtactgttttctttactggaattagaactaattttagtatttgctgtattgtcttgagctatcgctttatttcttaatgtattacgaatagattttgttccatcttcattagttactgtttctgttactaattcctgattctcatttggagcttcagtgatatttattgttaattctttcacagtttcattgccagaactgtctctagctgtagtttttaacacataagttcctaccgtgttactgtcaattgcactgctgtcgtatcctacttctactggtgaaagatcagttgcattaaacaaattaagattgtcaaaatcataagcacttaaatcagttcctttaacaatatcaatactgctgtattcagtgttcaattctggagctgtagtatcaacaactttaacttttttaataagcatttcatcattaaaagtcattgttattttatagtcaccaattgttggataatctttaccttcctcatatttaaaatttgactttatctctactccctttttaagaacttctttttcctctttatccattccttttgtattcaatagtttcatgctatctacagaatacttatcaccatattcaatttttattactttactgtcttttaaaacaaattctggtaatgtatttctagtaaatgcatatatacctagtgtactggctaagacaactgccaatacactaattcctgaaataatttttttatttttaatatctaaataattttttaaattaatcattctcatatatcctcccgttaaagtaaaatactgtttactaaaagggcattacacactttcatataaacagtatttaaatttcacttttacttgatttggttcttaccgtacgattatcgatgccacaaagataatccaaactaacattatataaataagctaatttaattagtttatctattggtggtgtttgtacacctaactcatataaggcaagtgatgacctttttataccagttagagtttctacatcattttgtgttagccttctttctttacgcaattctcttaatctatctccaatattcatatgctgctcactacccaaaaatataatatctaaaaagatgttattttagataacattgttgtaattagtaactttttcttattgatttatggcaataaacttttttacaatagattgaaaatttggatccataacgtacttttaaaacactataatcattttcttttaattttttacatatattttctaaatcactaattggaatattaaagttatacagcacatatcctttgtttataagattgaaatgtatcttagattctaaaaaattcgtaattatatcactattcatatatttcttatcctcatttttttattttataaatatgtatatctatccaaaatcaaacaaaacaaatttacttatttctaaaaattcactatttgtcactaaatatttatcaatattaaaggcataaagaaatgatttgaaatcatcaaacaatatattgctattaacaaatttttttgtatttccatatgttactactatgtcaataggttcatgttttatataatcatcactaatagcaaataattccctagaatttatatagtgttcaataatatcgttagaatcatttatttcaaaaataaaatcaagtaatgtaaatgtatgaagtacatatttataattttgattactacttgttatatatgctattaaatcagtttccagtttctctctttttgcttttacagtagaactattagaatactgttctactctatttatgtgtttaagtttttttaactcatcgtttgttaaaattaattcactttgaagatcattaagttttttttgatttttcttattccttttttttaatccctgccaaagtcctaaacaaaaagaaataattaataacattagttgttccatttttcctccaatataaaaggtggcaaagctgccacctatattaatattctgattcatttatgtttatataattaatttttaaattaatatatttactcttttgctttgattaaactgcctcatcctatcttcttctatttatatatttctgtatttttttctgctttgctaattcgttcacttatatttttatgttcgatttttaatttgaacttttcttgtcttaaaggagttatattttctccaacaaatttttcaatttcatcatcagttgcatcaattattccttccatcacttgttccataagctcatcatatttgttttcaaacatctttattttttcattaatgattcttaactctttagaaatctgtcgtcttatatctttcaaattagacagatttaatacatcattaaaagtatccgatgatgtagcaatacgatcaagtatattttgtatttctttagatttaaagtggatatatttttgctgtttagacattgtataaaaatcactttggttatatttggttttaatattagcattatcataaaagacattcttaatttctttttgtcttttaccttctggtttaacatttatgacatttgctatatttggatccaattcatcaacattattatttcttattcgctctataatgtcatctagggaataatgtaaatctaaattttctctattttttaaatatttgcatcttctaaaatattttgatccaggaacctttattcttaaaccttcacgaatacccctacaatttttttcctctaaattctgtgatattatcctgccacttttatttgaattaattatatttgctgctttatcatagattacataattttttgtcaaatccattttgcattttaaagtatttttttcagcatttacccatgtaccattttctataggaatttgaaaatattcatttgtaaatggaattcttataaaataagaatattcatcagacaaactttcattaattaactttttattaattgtaaattcaaaatttcttaatctattttcatctatctgttttactgcatctaaatcatcttctactgtataaccaatatttgttaaatatattttcaattgctcataactttgaactttattaactaagtaatctaaagttttagttattatcgtatcatgtccatcacccattttttcattatgatgtttccaccaagatctagatctactagtacctctttttattggtaatggttctataccataatctttacaaatcctattttctgtttctttaaaaaaatttatttcttttttaaaataaatattccattttttattagtatttttatttattggattaacaattatatgtgcatgtaaatgatcagtattagtatgaactgctattacaccatcatattcatcattagtagcttcagataaaaatctttctgcaatatcatgaacttgttcagaagtcacattcatatcatcaaaagataatataaaatgatatccctgtacaccatcagaatttaacctatcatcaaatctaatatgctgctgatatttccacactgttcccgcaagctgtggtacactgcaatttgtgcaacttgttaacataggttcagttttattctcatctaaaatataatcaattgcatcttgaatatttcctctaagtgaatgtactttaactattgcactcatttatctctcttccttcatcaatctgttcaacttcattatctctataatctttagaaactgtattttttaaaatttgtccatctttatacatattgacaattttaatagtaaaatcatttaataaatttcttaacagatgtagttcttcattaatcgaatctaattcatttgatgagatatcttcaccaaattttatttttttatttattcctctagcaatttgattaatattatttccaattcttgtcaactctaatgaaaggatatctaaattttcataattgagatatatactcactccataaattgcttgagttcgtacatattctgataaacttaatttaaaatttttagctttttttaatattatttttttctcaatatcttcaattctaaaatgaatttcttctgttttctttatcatattttttctccaatctaaaaaggtggcaatattaccaccttttatttttataaagtatacaaagggtatgggaattcccataataaatcgccatgaattatggtgatttgtcttgtgtacacaaaagtgacgatttaggaactttttatgtgtacacaaagacctaacctgcgaccgatagaggtcgcctaaatataacattttaggcgttattcaacattttctggaaaatttacattttgatgaaaattttcctttggcttttcattttttaaaagcttatcaaccttttgattaaaacgttcttcttcatgtttaagtttcaaaagtggtttcaaatcttgatcaattttttttaatttattttttgcctcaagaatttcttgtttgcatttattaatctttaaaagctcattatctttcattttatttaaatctttaattctattatctaattctttattcatttttcctcctcttttttataaaaaacaatcagtatttaaatagatttgtattataaattattaatacattttaatagtatcattatgataattgcaaaaatatagcctttttttctacacccttttcataattaatctgttaacaataaaaaatagcaaaggtatcaaatacctctactatttaaaatatcatcaatactatttaataagttaccaccattctttattatatcatttgtaccttgatataaactatttattggtgaaggaatagcaaatatttcttttccttgctctaaagcaaatccagcatttataattgcatttcctttttcttttgattccgttaccaataatatttcactcaatccagttataattctttttctaagtattaatttttctttcgtttgtaatatactatacggatattcactaagaattaaatgatttgttttcatctctcgataaagattaatattttgttttggataacaataatctataccacatcctaaaaccgcaatactatttccttttgtgtaaatagaatttttatgaacaattttttcaattccaattcctaatcctgctatagttgtaaaattttcttttgataattcttcaacaatcttacccgttatttctataccataatcactaggatcagtacttcctgctaatgaaatacatttagtatttactaagtcaagattgccgtagtagaataaaacaaatggaggatacatgatttttttcaatgcttgtggataatctttagatatgatagttgtataattactttttaattttttaaataaatctttttttaattcatcattaatttgttccttattttttacagcgctatatattttatcaaaatcaccattgtattttaatgaaaaataaagtaatagttcttccataatttagctccttttatattaatttattgtgattttactactaatgttgtagctcttaactgcctagtatgaatactaccattatcaagactcttaattttaaaattaattgtttttctagatttactgtaatacatttctaaaatttcttctttataaccataattccaaattgtaatatcaccaatttttaaactactagcttctactcctttaaattctttactgataccttgtaacctcattttttcacctcttttcttttaagtttaaggctttttgtcctgcctcactttctaaaagatacagcataaaataaaaatcaaggtggagacttgtactaccttgatttattttttatgctgtataattcaaagacaaaaatttaaatataggtatttttttacttcatcaaaatgtatatttttcatatctttcaaaattatctttattttcaacatatcattaatttagactttttattcctctttattccttataagtttttaagtcgttcataatatctgtatacagtactgatagaaatatttaatctattttttaccataatcaaattcttttcattttttaacaaataataaatatgtgtatttcttaaaatatttggtgtaattttttcatcagtatctaattcattactaatattttctaaaaaaaattcaacacttctttcacttaatttcttatttcgagagctaaaaagataagatgtattattttcctcaacatcaaggtaagacctaattaagaaaacacattttgaatcaagtggtaaaaccctttttttcttgttatgtgtaatacatatttgttccctatcaaaattaatatcagttttttttaaacaacataattcactaagtcttatacccgttataagtataatctcaataatagcataatttctaattatcaactttctatgatagtgattttttgtatgcatttttttaatcatgtaatcttctaaaatttttagtgtttcttctgttaaaacacgcatttttgtttcttcggcaggtaactcaaacattgtctgtttaaatggtgatatatctacaaatttctttttttcgagatatgcataataaacatgtaatattcttaatttatttttgactgttacaggtttatagcattcttctaaatgcattttatagtgaattaaattttccaagtcattatatttatcatcatagaaattcaaatactgatttaaatttattttgtatgttattgatgtatttttactgaattttttgttgttttctaataaaaaatacttcatatagttttctaatgttacttttgaaatcattatttttcacctcatatcaaaaaataagtttgatactttttgaccagttctttttctgtatttttatcaagatgataagcactatcatcttttaattcctttttatagccacatattcagcattatcagttgcaccatatccatattgataaactgattatacaattcatctattttctttttcagcttttccgttttttcatatttcctatatctatcaatttcatcaatctttaaattattaaatgggtgtcccgtacaacaatctataatgattttgattaacaattttttactgcatttactcagctctttttcgatttcattttcttcatattcactcatttctttaatctccctatatttgatgcgctagtactataattttatttatttttcatcatataatttccctctggaagattttttataaatacaattttattaccttcaatccttccaaccttttcttttgttacagtatttatcaaaaagttatctttcttttttaatataatattttttctctttttaaataaatgcatcttagtttcctccattttctctaataatttttttgaattatatcttcacaaagtctcgtataaacattggtaatcaaattatgtattattaattcaagttcactttgtggattgcttatcattttccaatcaataaaacccatatcatcaaattcagcatcaaaatattcatatacttcatctttgttaattaatccatttatttcttgtaattcagttaaataatcatagatttcagcttgaattctaccattattaatattttttattagatcttcttttttcttataattaattcccatcatgctatctatcctcttttctacatattttaatcaataatttcatgcaatcttttaattattttttctcgtggtgttttaacaaatcgacatccttttttaaaataaactctttgtaaatcaacaattctaagttctaaaaaatttagtttagatttaaaattcatattatttttatgtgattcaatcacataatttgttttacatttaataatttcatcttcacttttcttaatactacttgttggtattattagtgctttaaaattaccaaaattttttataacataacaccaatgcccatccattagttctttaggaaagcctctgccaagattcacatagactaatgtatgttctttaataaaataagggtattttagtataaaatttttcttatcggtatcttttgctaatttataataataatacagttcattaatatggtgattgtatgaccttattaaattaacaaggtcatacacttcaatgtgttccagtttattaacatttaacaagaaactatttaactctttatctagttctttttccactaatttaaatattcgctaatcgttgtttgaacttcatttttttcttgtttaatgtcaattgcagtttgaatacagtaattaaatttatttattactcgttttatatttataatagcggtgtcaactgaaacatcattatttttttcatcttcagcaattttaatatcaagtaaatttgcttcagttgctttattattaattttctcaattgtttttattattttattaagatctttaaataattcagctaaatcatactcatttttaacttttgatcctgtttcattaacatttacatttagttcactggatcccttattttttctttcaacaatatttatgtactcttgagcagttcgtccagatttagcaccaataaatggagctatccagtcccttttcttaccagaaggttttggatctaactgttcatatatttctaacaattcttcaactattttaactttttcagtttttgacattattctagtcgcatttgctagaataagctgtaatctttcgttaattgaatttgaaggaacttcatattcaatacaacttatttcaggttctattttgtctgcttctactaattcctttaaagcagtatatcttctttcaccatcaataattttatacaaacctctaacttcatctttataaacatctaatggttttctaagtccatactgtaatatagaattttttaattcttcaattccattaatgtcaaatgaattattttcattaggtactatctcatctatatcaatcatcctcatacctttaggcttacgattcatttttaatttatttccactcattaagcttgttaataccatattcaatacctcttttctttaatctatttctaatactaattcattaactaaataccgataatcttcaccaattttagatttatcattaattataagttttgaggccattgtagaccgtgatgcaactgcatcttgataaccaatagtagtattaattacacaatcaccaaaaaattctcgcattttagaaataaaatttatatagtcaggtctatttcccctaggaatcatgttcattaagattttaatgttatattcaatttcgtattcatattcaattgaaaataattcctccattgtatcaattagaccatctaattcaaaaccgcctggtttaataggaattattatattattactgcaaaacagagcattaattgtaatattattaaaggttggcgcattatcaattacaacaatatcataatcattttttacttctcttaatgcccttttcaaaattgcatgtcttaatccattcgttgaacctaataatttatctgtttgaattagtttggtacctaatgatggaataattgataagttttcatatgcagtttgataaatacatttttttatatctgcttcctttaaaagcaaagaattaatatcatttctgttttgagtatttcttaatgctatcttaatagttctaactgattttagaatatctgtatctttagatactgttaatttattaaattctttaattggtaaaggtttataatcaggtagaaaatatttgcttgcattaccttgtgcatcagcgtctactaaaagaactttcttgttcttttgagcaaatccacatgccagattaattgctgttgttgttttaccaactccacctttttcattaataattgaaataactttcatcttttttcctcttttctattaatttttcgagactttttatccctgcctcactttcttaaagccaccaattgttgactaaatcaaggtggagacttgtactaccttgatgcaggatacaattggtgtaattcaaagacaaaatctaaaaaaacatttgaatttgataattatcatctctattaatccatacgttacatatgtttgtactccaccatttatcaatcaaatatagaatatattcttttaattttgctaattcgtacttataattagcaaaattctgtttagttcctgtataaataaaacatttttctccagtttctttttgccattttatatttgtttttctaacaatcatatcaattctaaaaataagccaatgaaaacttttaatattatcattccatcctgtatgaaaattaccttttttgtcataataagctagtccatctgttagttttcccaaaaccaaggcttcctgtaatatattcaattgattatttatttgatcaataagtttatttttatatctactacgtgcaatatcgtacttatttaaagtatgtgatttagaatgactaatgtactttttagatttttctaataacattagagttgttctatttatggttagtcgaacatcagaaactattgatcttaaccatgacgttagagatttgatattaaatccctgatacttaaaaatttctttttcaattggtgctacataacatttggtaactattggatttccatccttatcaatttttaattctccttttttatgtcgaagaatagctttttcatctttttctgtacttcttctctttgttattggattccaccaataatcgctgttataagtaacttttttttcatctggcgttttatatacttttctagtaaaagcaataatatctgcatataatccttttccttgtctgcacaatttataacagtatagaaaattattttttttataacatcctgcaatttgaatcatatattctgtaacaaattttttagcaatttcaaattcatgtagctcgtgtggaatcataacaaatagcgaatgtgcatagatattcctataaacttttttatttggattctgaccataattccttttgtgcttatctttataatcatttagatgatttacagcatcaatataatcttctcgatttgagtaaatactattattatcatcaaaccacttatccacatcatctctactgtcaattgtttgatatttaacataatttttataagtaatcatttaatagttctccctttattccagctgtacacataaatcgacattaaagcttcgctttaatgttgttgaaaattatcatgattttttcagatattttcattattcatttttaatttaaactgatttgcaagttttatcttttttgcattattaattacagttttataacccttacccgtttttttcattaattgataatattctttctcatcaagaaaaatattgtacaagaaagagattgtataaattgctcgttgctcttgtcgatattcatagcttgttcttataattttttcatcatttgataatctatacagtctatcaattgttttattttcaattatttttaatatttctttaaatgtatcatctgtatcattattattcctaaatatcaccatgacggcttgtcgtaaagaatacgtagttttataatttgacttaagaaaatttacataatcatttattgtataagaaatatcaggatctaatacggctataattgcataagatctatttgctatttcgtatactttcttttgttccaaaagtagttcatctgcaatatgagaaaaattaacattgtatacataatgtgattcaataacatgtctatatattgcttctaaacttgatataaatctaaggtatttttttattaataactgttcatctaattttttttgtatactatgtgaaattttatcattgcaaagattatttttatctttattcacttttattaaagaagtagaaaaagatggaatataatctgttgagctagtattttcttttattattctgttcaatgtccgtaaatttctttttacgattaaaactgcattattgtgtttttttaaaaaaatatctttttcttctttaaacattaaaaaacctctccttcattttttatgaaagagaggtttataaaagtttaatttataaaaatgtattaattttgttattaaaaagctggttcgatccccatcgtccgccccattttattttaatcgaaaaatttatagcatagatgacactgtatagctatataaaatttaaaattgtaatattttcgtccagcatttattgttgggctttttattttatataaatatgcgtgatttattcctctttattagtagaaaattattttttctatttaaatttgtaaagtcgaagaaatactatttatctccgactttcttattgcatttttctataattaatgattattaaataaaaacatgataattatatataatgcccattttttataataacaattgtgatagaccattagtaagcatgtattaattacgcaaatacttgataattcaattcttgatatttattattttttattcataaatatttaatcttcattcacactatccatagtttctgctaatttagttaatttaattgtagagtaaatagaataaattattctaattaaatctactattataaaaataataaaaaatacatccatctcattatctatataaaagatcaataataaaaatacaatatctattatcaatccaataataatctttttgtttataaaattttttttcactaaataccccaccttttaaatacagtctaaatattagtgtttattgtagtttaaaccctagttgttactgttttccaatttacattaggataagtgtcaccttgttgtgaatgtgcaggaagacaattaggatttttatgtaaaaacgactctgctttatattttacatttggttgaagagaatttaatatttcttttgacagcgtagaacaaacatcttcaccactatccaccattttagtagtttcaactaccgtttttaccacaggccaaatactattttgtgattcaagacttaattcatttaattctgccatacctgcaggtaaagattttaattcttcatatattacattttcattatttattggtgtttgatatattattactccatcatttccatttgatattattatcgttgctatagcattttctataaaataactctccaccctatcaagattgatttttttattttcaacctcatttattgttttaataaatatattgaataataattcatcatcactagcagcaagtactgcttatagataaaaagaaactaaagttaatgcaaatacaactaatgtagttaaaatttttttcacacttattatccttcccttacttgtttatttacaatttaccaaggatagtgtatgaaataggaatatgcccatctcaattgtattatgatatatcatccccttacctttcttaattatattatactattaagtgtaaagttataaaacttttttcacaaacaagttatccttgaaaacaagcaaattatccatgttaatgaataattttttatacagtaaattaatgtgctataataagatgcttttttatcattactattcacaatcgttaaaaaattcaaaaatccaattaagaacaggcaaatagatacaatattaaaataaatttcatacttgataatgtatcaattttaggattctttacttttttatttattattctgtttaaattactagaatccatttttgaaagtttagaaaggttgtaagttgaaatatttttttcttccataatagctatcagtgctcaaatattcataattccctccatttccgtccgccttcgtcggtcagacacaaacattttattaaaaataattctcatccaatcgtttttgtagtatcctataagagaggtggtatactacagagcacgtggaggagagtaggcaattctactctatatagaatatcctgaataattataagtcgccgtcagtctttcaagcacaaacaagtaggacttagagcctggacacttaagattgtttttatcaactatagtgatattttgcagactgacagtcaatgccacttctccttttttgaaaggagtttttttatgcttaaaatccaccgttttaattgtgctggtcttgatgttcacaagaaccttatcgtcgctaccattggtatcactgacaagaaaactcatgtcactgaatatattcagaaagatttctcttctcttaactttgacctctataatcttaaaaactggcttattgaacacgaatgttttgatgtctgcatggaatccactggtaagtattggttccctgtctttaatgtccttgagactgaagctaaaatgaatattgttcttgtccatcctaaatatgtcaaagctatcaagggcaagaaaacagacaagaaagattccaaatggatttgtgatcttttcaagcatgatcttctcaaatcttcttttatcccgcctaaggatattcgtgaattaagggatctctctcgttatcgttttaagctcatctgtatgagaactagtgaacgtaaccgttatcagaactccatgactgtttccaatattggtttggcttctgttgtttctgatacttttggaaaaacagcccaggccgtcatgaatgaagttctatctactgaagttattgatgaagataaaatcacaaaacttattcatggtaagtgcaaaaacaaagataaaatagttgaatctcttaaaagttcaaaaattgagccagatcaaagatttaaaatggcagaaattcaatcacatatgaatgaacttaatcaacatattgaagctgttgaagtagaaatcatcaaacgtgcttccagatactttgatgattttttacatattacagaaatagatggaatacagcttatgtctgccattcttatcatttctgaaattggcgttgatatgactcaatttgaaacagataagcaactatgctgctgggctggactttctcctgccaataatgaaagtgcaggaaagaagaaatcagttcgtatcaacaaagctggacaatatcttaaaccagtattagtacaatgtgcattggcagctatcaaaaacaaaaacagttattttggtcaaaaatatacaaaaatcaagaaaagaagaggacacaagaaagcaatcatagctattgcaaggatgatgcttgtcagtatttatcatatgattcttactggagaaaagttcaatccttcagactatgaatcatttaagaatccaaagccacaaaaagaaaagaacaattatacagttgagacagcacttgattttctaaaatcacagggatttgatgtatcaacaattcaagatattcctaaataatattctgttttttctaaataaaactgaacttgtttttaagttcgtctttttttgtgtttttactcacgattgggttcaattatttttcacacttttcctcctcgttttgatatataattttttgattttaataatatgttatttttatgcttcagcgaagctgaatagagagcttacttagcaaaattgccaagtaaaaatgataaaaaagaaattgaaaatattattataaataaaaaaggggctgtaacgaatgaatagtttttgactattcattcgcttttttatgtcccgtttttaatttctcctcattcataacaaaaaaatatccaaatatttatttacttggatacttttaggtatttttgacgcacttaaaaagaactagctttctttttttttaaaatttctagcttattgattttttttcttcgtattctttgtttttttgtttatatctgtgatatttcctcagattatgtcctattccgactaacagtatctcttcttttacaccattttctcccctccgtcgtaatcttccatatccctgatttgtttttatatcaccaaatgttccttctgtttcactgcttctcttatttattagtttttttccttcttcgctttccagattctctctgactgttattcggtggattattttaattaaaataacagctatttagtcaaataaaaataataaacatagaaaaatagttaaaataatttgataaaatgataggcaaattattttaactattttattattatataaaggagctgacatacaaaaaaagaaagggtcattggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcactgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaatagtgaaaaaatagcctgttatatgaacagtattattgatggattgacgatagcaaaaggattaagtataataagcgctcatatagcacaataccaggcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacactctgacctctttttgatattcctctaactggtagttatgattaattgttcgtcctgattttgattttgtacatctgcttcttagtggacacccttcacagtttttatttctaaacagaaaatttaatttctcataatcacttcgttcatcaattgtgactttttctaattcaaattcatgtcctgccggacatatgaatcctccttcttctgtccttttcatatggttttttttaaatctgtttttatcatttgttttttctttctctttgtaatatccactatatttcatatacaactcgatattatgttctttacagtatgcataattttcataacttccgtatcctgcatcagccggtgttttcttaggataacatccatatgcttcatgatatttttccataaatggtatatatgtatttatatcattaccatcactgctgatataaatatttctaattattccatcgctcacgcctatttggatattatatcccggtttaaatacatttgtatgattataataatcatatttcatatgcataaaggttgcatcaggatctgtcttagaaaaactgttcctttctcccagaatgtccatatgaattgtatattcaaacatcttcatcgcgtgttcttttaattcatcatataatttttgaatatcacttcttcttttgcccctgccatgtacaaaatcaatatcttcatctttcatgtattcttctatcctatcactgatattcaataaataatcgatacttggttcttttagtaatgaatatcttagattgatattatttttcttaaaatatctattgattctgtcaatacactgattagtctttttccagcgtttagttctgtttctgatcgtattagcacgccaaacaaaagtatttttattagcattggcttcatatttagtcccgtcgatacataggacatcggtattgatattcatcttttttacaatatacctgttgatttcataaaaaatatcatcgatagacatctttaaatcatcattgatgaatctttggaaagccatatggctgggacactgattcttagcgataaacatatatctaatatcagttttacaaagacgttcaaggcgtctggtagaagcatagccgtattcagctttagcaagcagaactaaaacgaacatcataaaggaatcataaccatgggtatttctgtgagagaagtcgacatacttatttatatttacctcccgagcgacttctaaaacagttctacaaatatcatcatggggaacatctttttcaaaagaaaaagaaaaatccagtagcaaataagattgaaatgagttataatttgaagtgttaatattaatatttgacatgaaaatattataccaaaaaaacgctcgcttgagcgctttttttgttttatgaagctgtaaaataattatttactcgttacagcccctacatttccatttcatcaatatctgtatttatttctacaaattcagtagacttatgtaagttccttttcttgattatgccatcaatcattatactcatttgttctattcttttttcaaattcaattgacaatttatctattcgttctgaattcatatccgtatacatttgatatttttttaatttttctttgaactcaataacaataccgtctaatttacttaaatcaaatctagaaggatcttgtatataattgaggtaatcattaaagcttttatttacatttgaaaaaaatttaccataatcattagtaaagtcaatttcatatgttaatttttcgcattgcattgattgtccgttatcaaaaatcggtactactttagaccattctaacgtctttacatttctgattattccataatttttcatatgtctatctttatttaaaattaagctatcaagaaaaaacatattttcaatttcttgccttgcattagaaacattatgttcttctaatatttgaatgtaatgttcaaaatcactaatgtggttttctttcttttttgatctgtaaacatcaatagcagttattatctcttcatcatcttttataaagttaatgcacttggacactattttattatagataatatcaatatcataatgacagtgttcaaatcctaatctttcacatatggcagatgcaagccattcattgattggctcttgtctacttgcagtgtaagtacttttaactagtattctatttttaccttctattatccatgctttttggagcataccatctgttgtattgtttggagaatatatctctggtttaatattttgagatgaacttaaagataccattaaatatcctttgtatttaaaatcattattgaaaaagtttatatcttcccaactaatattttcattttcaggttttatccagtactggtcgcttaatgatagggcataagccttatttaataattcattagtggaagaaatatttagacgttctaatagtctttctatatcttttctccaagaaggaatgccccttcccttaaaccaattgtttagttctttttttagatttttggatttatctttataagcgttatataaagataaaggagaataatcaatattgataatttcatagatatgggagatagtattactgtcttcatcatattccatgtaagttatttttttattttgattcattaaataacatttcatcgatataaacacctctcttgatttttcttattatatcatgatatgagttgttaggtaatttattttctgtattattttgtcagtagttattaaccataacaatttttttacttttaatgctttagcgaagctgaataaggcgcctacttggcaaaattgctaaataggagttataaataaatatatcaatttttacttaacaattttgctaagtattgcatttaatttattatcaaaatgttcatataatgaattttgtgcatcagcgtgttttgttgaataaagttatataatatttattaaatttttttcaattttatcatttataaaaatggatgaaattattaagatcagatttacaaataagtaaatcaaataaaaaaaccataattaatgcctataatcgcaatcatgtaaaattaaatataaaaaaatgtatagagtttggcgaatgattgttactgatgaaatagaagaattaacacatgaatgaaagagaaaacaaatatgcatgaattattattaatattttaaaatcgaaattggtacaaataataattttctctttaaatttttatttacaaaaaatttaaaagagctcttttcgaactctttaactacgatacatcatattcattttacgaatttcttctttaatcttatcccttaattctaacggtttaaaaacttcaatatagttagctaattgtaaaaaccatcctacaagactttcatcataaatagcattttcaatcgaaatatctacaaattgatgaaattggttaactataaaagcactctctttaaaacgatcacgcaacatttcaaaaactttattactattaactgcatatactctaatttgtaaatttactaagacgttctttgcaatatgtagaggatcattaaactgccaaattttatccttaaatgacgcaactttattttggacatatttaggcgttcttaccaccctcaattcagccaaacgatcaatacgataatattctaattctaaattctcaccactattaatatgatatcccaccatataaagttgattatcaataatatcaatattagttggaaacatcaaaacagctttattagctataacttcttttaactcattttcatttacaacataatctaatcgtttaaatgatacacaagcaaaattatttacagcactaattattttatctaaataagtaagagtgttattttgaaaatcttcatcacttaaatcatctaataaacgatattgattgattttatgtaatgatgtgtccgacaataccttttcaattaatttagaattactttttttatctaaacttaaacacttccgtaatagccttgttaatacaattaattcgacatcattataaaatgtcttttcaacaaatgcaccccttttttgctttgtagtatactcaattcttccactttcagaagcattgaaaggtgctaataatttatcttgatgatcattaataatatcgttgaatgattttatcgattcaatatcagccttaatagtattacttgatatgctagttcctaactcacctattcttaaaatcagctcatctctagaaagagcatgattttcatccgttaatctctttaaaagatattctgttaacaaaattcttgtaccattgctaatatctcccatacattttcctccagtactttaattctactttatctcttcaaatatgtaaaatatcaactggttatatacattaattttttggtacatttaaaaaaataataaataaaaaattcaaaattttgaactttcttattaaaaataattattcttctacttaattaattactttttaaatttatatacatcttatatttaaagatatattaaatgatgccagattaaatatttatcattcttttttactataaattaatcctcaacattcctttttgaccaactattcacatttaaccattattttacaattactgtacattagttataatcactcattatcaaaaataaaattgatccgtccaatttctaatacaaaataaaaaagagatttcttatttgctgataaatatacagtttttgaaatctcttatttttagttattgataatcaaaatcatctcttatcttttaaaatttattctattaccaaaatacagtaattgattactatatattaactagaaaagcgttccctgctttccccaattttgatactcatcaaatgaaacatatatatctttaggatcaatattagttgtatccttgatcatttttattagttcttcagtgaatttctttttagcttcaaaatcaattgatttgtataattttatagctatcatcatacatggaatatcttcacctctaaaatacataatttgattatcttctaaatgaagcattaaattttcctcttttttaccaggtaagatcgtaattaattcacctgtctttttagcaatatcattctcttgtctaagagttagtttatgatttgtcgtaaatgaaataaatggcatatttatcttctagtatattataaataaccactgcattagctatctataaatataccttctcctttctgttatgaagtgacctttgtcaagtgaaaattacacattcataataaaattatttaattttatcatcaatggcatacaaaagccccaaaatactagatttatcgacagttaaccactctgttatacggagattggctactccaaggttaatggttcgtcaaataagttctaactatctatatacgtgaatcatctataatttatgatattccagatcgcgacttcttttatatcttatttatgccacaaagaaaggaccgtagataactaaacctgcttctccttttttgaggcttttctatgccattgattttgtgttctttttttctcgatttttgtcctccatttcttattttttctttaaattttcataattgtatagaaaacatctttttacatcttctatattcttcctgtttccattccccatataaatcctgctagttcccttgccactgccatgatagctacattatatggtttccctcttaataccatccttctaaatcttttttgtaatctttctactgccttatctgcatatgctacgatttcatcctcctgtcctttttgtctttttttcaacgcttttgatttctttccaactgttcctcttactaatgcctgtgtacattctaccagtgtctttctaaccatcgcattccccatcttggtgattggtgtattgctgtatttctccgcgctcgaattctctcctggaagcattcccagattcgccataaatgcctttgctgttggaaatcgctgaaaatcactcactgtgacatgtatcttcattgctgataatgtatctattcctttgaaacaggaaattttagaaaccggttccttatattcctcttcttttgaaaactcttctatcctttcatcatatttttcaatacgttcatttaaataatcatagacttttaaatattcatttaatgtttctcttacgattactggcaattctatcgtttcaagccatttgatatgggccactgtccagttgcttttcccctcatatcttaatcctcgtctcaataccaatgcactgatctgctgtttgattctctttcttgactggatgacatcttctcttagacctatatattccttgatttcattgtcatgttctgttggtacatgaacagctttgtatgaatcgtgcataagattagtggcaatattaaaggcatccatcttatcattttttacttttttatttttgactgatccatgcattgttgatggtgctaatataacacatggaatatcatggtatgcaagttcatgatataaggaaaatcctaaacatccagcttcatatcctgttaaaatatccacctcattttcttcactcattctttctttagctgacttaataaatttaagaatattctttacttcagcagcacattttgtctgtgcaataacttctcctgttgatgaattgattccacataaactgtacgtatttttatggacatccatcccaatataaattatacttttcatagtgacctcctattgtcgttatggtatcgactttcataattttgtttttttactaatcttattatgaatcgtaatccactttttgacaacttaggaggtcacttcatattatctatcaaccatttaaaccgtggctgattacggtaaaaaaatataaagaattgaaatatatgaaataaacccatatttatgattttaacaactttaaatatttttactatacttcatctttaagtatgctgagttttaagtttgtaacctatattaaattttataaattaaatatagcagttattacatcattaataaaaaattttacttttaaaacaataaacttatttaactcactatttaaataagtatattaaaacacacaaatatctttattattaaagtcattatgtgctctattaaaatattgcttatactaatttctaagactaaacaaacatattaatttctaaaaaagataactacttaaatttttcaaagttttcacatacttctagctaattcaaattatcaaacttttcataaaaaccattcgaatccttatcattagctctttatataattttgctatatattattttaacatgtttttaatctattgttaataagcatttaatctcaatattataattcataaattcttcttatattttagttactaatgcatatcctaaacaaaaaatcaaagcatttacctaaacaatttgctttatctaaaaaaatgtggtaatataaaagggcaaaagtagcaatataattttcaaagtatcacaagtattagaagattgtattcctttatgtaccggcgcaatccaatatttgtgatttagagttacatagagtatttcctttttgcacatctttcaaggaggtaccagtgaatgagtacaggtaaagttaaatggtttaatcaggaaaaaggttttggatttattactaatgatgaagatggaaaagatatcttcgtacacttttcagctatcaatgctgaaggattcaaaactttagaagaaggtcaaatcgttgaatttgacattaacgaaactgatcgtggaccacaagctcaaaacgtaacagttaaataatttgggcaaaatgaacccattgggtcatgtcattaaattggcatatagagaaattagttaaactagtttctcttttttattttaataaacataacttaatatattctattttgtaatttatgttttaagatatttattgatttgtgaatatttcaaaaattatttgtatcaaaaatattaaatttttcttttaataatacttattagattattgatctttgaatatttattaaagcataattatttaatatatgatagaataaaaagtacggaggtttagtaaatgaaaatatatcgtggtttagaatacagtttaaaaataaaaaaagtaattattgatagtataaaagctgctaaaaataatcctttttcagaatattattttattgttgatgatccattattttttgaagaagctttttttaaatatactgatactttgtttaatttaaaaattattaattataataatttattgaaaaagctcttagataattatcatctttatcaatatgaaaaattatctatattagaaaaaatattaattactaaagaattgatcgaagattcaaataatctttttaatacagaaaataagatgcatttaatttatgagctaataaatatatttgacttattttacctagaagaaatcaataacccacaattaaataatttaccgctactatctaaagaaaaaataacaacgatcattaaactctatcaactgctttcaaaaaaaattcctgattttaaatgttatcagtatgaagaattattatctaataaaataaataataacattgcaaataatcactatatttttataactgaaaaaatattaaacaaacgctgttttcaattaataaaggaaatcgataaatactgtgatgtaactattttaatcaatgactgtaatgattctcgtgatttaaataccccttttaaaaaaattaaaggtgatgattatttcgataattttgatttctcttatcttaatcatttaaacaattatctattctcgcttcaagccccaaaatttcctcataaaacacctttatacagcttagcacagacaaccccaaaagctcaaattgaaagtgtcgttttagatatctatcaaaaaatcgtcgataataaaatgcattatcatgattttgccatatattatcctaatcaagaatatttagagctgcttactgaaactcttgataattttaatatccctcacaacattaaaaaaacaattattttcaaagaatttgaagcttgtttatcatggcttaaatattgctgcagtaatgatgataatgatctgcttgaattattggaaacaaaagttattaatggctatagtgattttaattatttagatataatcaaaaaaaattatttagaaactggtgttattgaagatccttttacagcaaaatataattttactaattgttgtactttaactgattttagctctgtaatgctatcgtttataaaaaatgaaattatttatagtcaaaatcaggctgcattgatcaatttttttaataatttaactagtttacaaacatttacaataaaagatttttattatcttgttgaaaaattaaaaccggttttaaaagaagataaacaaatttgtagtgaccacctctacttattaaattataatcaatgttacagcggcattcttgaatgttcagatatatatttagttggtgtaaacgaaacaattgtcccagctcagtataaagacactggtatcttattagatcaagactatcaaatattaaatttgcctgacttaaattatcaaattggtctaaatcaaaataatattttaaaagcactaaacagtaataacaattttactgcaatttgctttagtaacgctactattgatggtcaaccattattaaaatcttctttatataatcaattaacacaaatgttttctattacaaaaatcgatcctcaaaacgattatttacatcatagcttaaaaaacaaactatatcttttaaataaacaagatcctgattctaaacaattaaacaccataatcaaacattataaacaaagtaacaatcaaccagatcatttatctattcctttattttcttcacaactttcatcaagtaaactagaaacatataacagctgtccttataaatattttaatcagtacggtttaaaaatttatccatttaaacaacctctttttcaaatcaatgaaattggaactattactcattatgttttagaaaaaacctcaccattatttaaagatagtcatgctgtgcaaaaaattgatcatagttatataaaaaaactgattaataaacatgttgatgaatacattgacattaatggtttaaatgataaattaaaatatggtactaatcattttattattacaatgatcaaagaagatttaattaatactataattgtattaattaatcaaatgaaaattactgattttaaaattattaataatgaagtagaaataaattataattatcatgattttaaatttaatggcattgttgatcgcgttgatcaatataataattatttaaaaatcatcgattataaatccagtaataaagatcttgatatttctttagctatccagggatttaatattcagatgctgctatatttggacgctttaacaaaacaaatgaagctagataaaggcgcgttactatattttaatactaaaaaaagaattcttgccagttcattaaaaataactgaggaagaaaatagtattaatttttttaaacaatataagatgaatggttatgtaaatgaagatgtgatcgaagctattgataattctatcgaaaaagaatcgacggttattaaagctaagtttgttaaaaaagacgattgttataaaggaaatattttaagtagtttttcttttgaacgtcttctagcttatgtcaacaagcacatccaagaattatatcaagaacttatttccggtaatatccaaatcaatcctaagggaagtgatgatgccacgactcataccaaagtaaatccatgtaactattgtaattatcgaagtctatgtaattttgatgttttctataatgactatacattagtaaacactgaaaatcttgaatatttaatcaaggaggaagttaataatgtcgattaactcattaaatgatggccaatatgaagctgttattacccgcaactgttcaattctggtttcggcacctgctggttcaggaaaaacaaagatcttagtaaatcgtatcatggccttaattgaagaagatgcttataacgtggatgaactattagttttgacatttactaatgctgctgccctagaaatgaaacagcgtttacaaacagcattagaaaaacgtcttcaagaaaatatttctgaatcactaaaagtacatttattaaaacaaaagcatttattacctaaagcttatatcactaattttcatggcttttgcagcactttgttgaaacagtatggttatttaattaatttaaacagtaagtttgatatttgtaccgatccagttattatcaaacaccaaattcttgatcaatgtattcaaaaatggagtaatgatgaagcttttattgaatttatgagtacatattttcctgaatattatttcagtaaatttaaaaatgctatttttaaatttgaaaatctaagcaacaccatttacaattttgataattatcttgaagaaattaaaaccacgatctatcaacatatcatcaatggtaatgatgatgtctataattcttggccaattaatcaaaagattatcgaattattaaaaatgcaggctaatatgggtttaaataaagtttatgaactagccgcttttgctagtgatcataatttatcattttattatcaaaacccttttggtcctgataaacctaaaaaggctgatttgccaagcccgtttgacacacatctaaagtactatcatgatgttattgaagctttaaatagtaatcaaatagataaaataatcatcgctagtaatgctactttaattaaaagctatgatagtagagggttatttaatgatgataatgaagaatataagacagaatataatcgtcttaaaaataatattgtgaaattttataaagataaatttaaggatcttgtttatgatgattttgatgaatttaaatcaactttatcatcatctatcgttcctttagaaaaacttgttgcttacttaaaagaatttaaacaagcttatagagagtataaacaaaatcataatattttggattttaatgatttagaggctaatgccttagaattattagaaccaaaatatggtattgctgatttattatataaacagttaaaagaaatcatgatcgatgaatatcaggatactaatcaaatacaagaaactttgatcgataagattgctgatttaaaagagcctaaaataaatcgttttatggttggagatatgaaacaatcaatttatcgctttcgagaagctgatcccgaaatcttcaatgaaaaatatttaacttttaatcaccttcctaatacaaaaagaatagatcttaaatttaattatcgttctaataaaattgttcttgacagtgttaattatatttttaatcaaattatggataccaacattggtggtcttgattattatttagatgagagtgctaaattaaattatgattttttaagaaaagaaggtgcccaagaattaagtgacttatctaaagtaaaaaaacaagcgacaaaacgccttgatgaagaaacacggtttactagtgaagttctcctatcatatcaaactaatacaagttcaggtgatgccgaacttgaagcaaaaatggttgctaaaaagatccaggatattgtcggtaagcttgaattagataattttgataaaactacgcgacttaccaattataaagatattgtcatcttaatgcgcaacactcgcagttttattgcatttaaaaaaatattttcgcaatataatattcctagtcatattgttttatcccaaggttttttacaagctcccgaaataattagcattatcaatgttttaaaagcatttgataatcatttagatgatattgcttttactagtttattaaaaggaaattttgtaattagctgttttgatgaaaatatgctcgctgctattagaagcgatgatagtctatctatgtatgataatgtaataaaatatattgaaacaaagcaaacgaattatcaaaacctagaaaaattcattgcttattaccatggtatgcgccaatattttaatcaacatactgtaaaagaaggcctaaataaattttatcaagatagtgaatacttaagtttttctgcctctttaataaatggtgttcaaagagttgcaaatcttgaattactgcttcaaaaaatggaagaaatgaaagatgattctttacatacagttgtcactaaatttgatcaaatgatgaaaaatggtgtaaatatgtctccagcaatggttgccagcaatgatgataatgttgtttcttttatgacgattcataaatctaaaggattagaatttcctgttgtatttgtttcaaatcttcaaaataaatttaaccagcaggatgcccgagaaagaatcatcagtgataaaaaattaggtattgcaatcaaaccgcgcttaaagcaacagcttgagccttaccaaaatgttgtcatcgaatatgaaaataagtatcgtaaaataatcgccagctatcagactaacgaagctataaatgaagaaatgcgcattttttatgttgctttaactagagcctctcaaaaacttattttaactggtttaattaaagagccccaagatatcattaaatggcaaaaatatgtaattaacaattataatgacatgattattaattcccgttgtcaagacaaagtgattctatatgataatgcgagaaaacagaatagttatttggactggttgggcatatctttaatgtcccatgatgatattattaatcagggtcttaacaaaaaattattaaataatcaaaatactgacgaaataattgatgagatcaaacataattttcaaactatcatgattaataaaagtaaaaatttaattcaggaaaatactaaacatagtaaattttcaattacaatatttagccatgaagaaattgaaagacaaatcatcatcaccaataaaaaagaaacaatttttaatttaaacgactattaccgttacaataattttaaatatccttacttgatcaattcagataaagcaattgctgtcacgcgaaaaatcgaagatggtgatcgcatctttgaagatgtaagctatgatatcgatgattctaatattgctccaactacgcgaggtactattattcatagtgttcttgaacatcttgatattaaacctgatttagatttagatgccaatctaacttatttaaaagaatctggtctttatgatgcagaatcatggcaaataattaataaatattatgattattttaaaaattttgtaaatagtgatgtatttaaattaatgtgtaataccaaacatctatataaagaaaaagaattttcaatgttggaagatggtcaaattattcatggtatcttcgatgtcatttgcattgatgataatgatgttacgatcattgattataaaaccgataatattaaacaaaccacttctgatgatatactgaaatcattacataaaccacaaatggattattataaagaaatattagctcgtgtttttccacaaactaatattaaagcaatcgtatattatctacatattaataaatatgttgtcttgtagtcattctgtttatcaaagttgttttactagcataattatccaataatgttaaattcatttaatagataaataaaaatgatttatttttaagataggtcagtaatcataaaactgagtaatatcacacaattatatatttatcacaagaagatttagctcaaaatttatgttacatgatagacgatttctaattgtgaaaacaaaaaagttttccagatattatgaaagaaaattttgaagaattctaatattgttgtttaaattgtcaacaatattaattagtttatcttacgccaaaaagacaatgatcagatcattgtctttttgattaaaaaactaaatatatttattttactactatatcttttatatttttaagaataattcgtgtcattccacgttcatccatttcccgggaaatatcgacaccctcaagataatcctcaacacttaattcaataactcgatcatcatctaaaactaatttacagcgtgacatccgatctaaagatacgggtacattgacaattacatcatcttcttcaatacctaaatctttcattatcgtctcaacttcttcggtcgcgttataatcattgcccataacttttttagctaattccattggttttactggacgatgttccatcactaactctgccaattctcttttaacaactggtaatggatcaccttcaataaccccatattcactatctaccttttttactaccttattaacaatactcatcttctgcttatcggttaatttaggttctcctttaatatattgctcatttaaataatagcctggctttccatcaatcataaatcttttttcgataattgacaaaataccatcttcaatatttataattattgcttcttcaacagccgttgtcttatttggtaaaatctgctgattcacaaaacgaatactacgaactccattattttcttcaattaaactcattggcatagttttataatttaatttaataattaaaatgtattttttaccatcaactttacattcaacaaacatcaaatttgcattaggcatttcttcgatttttgtacaaagatcaaatagatcctgggtaatttttattgattcttctttaaaattgtcatcattttctatcatttttcttcctgattgtaataaatgatgttcacttccgattatcagttgtttaattcctgaattttctaaacatttttcaatttttttatcataatattccgttgttccttcggtcaaattaataaaagtatccgaataaactactttactatgttctaaatctaacatatgaattaaaattttatcaattataattgtattattcattctttcatcaccacgacaagtatatcatattttgatgatttaaggtataataaagtgggtgataaaaatgaaaataattatagcgcctgcaaaggtaatgaaaactaaacaaattaatatcgaaaaaacagatttgcttttttctaaaaaaacagaacaattaaataaatatttgaagcaatatactattaatgaattacatgatttgatgaaaatatcttttaaaatggctgaaactgtttatacttattatcatgaaaattatgaatctacgcctgctatttattgttatcagggaactgtttttaagcaaatcaatttaaatacttataatgatagtgattttaattatttagataaatatcttaatattatgtctgcttattatggtatcttaaaatataatactaaaattacaccttatcgtttagatatgatcatgaaatttgatttaaatttatatgatttttggcaagatgaggtaaacaactattttaagaatgaagattatatcatttgtcttgcctctaaagagtttgcaaaaatgatcgaccatccccatttaattaatattgattttgttgagaaacgagctgataagctagttcgtaattcaatgtatgttaaacaggctcgtggtaaaatgttagatatcatggtcaaaaacaaaattattttattagaagatttaaaaaaaatcacttttgatgagtatcattacaatgatcttttatcaaatactaataactatgtatttatcagagatgctaaacaacaatataaaaaattataacagatggttacccatctgttatttttttagatatttagttaaaaactgcaacatcacttccatttgttcatctgttccaattgtaattcgcagatattgcgcaattctttctttattccaatgacgaacaatgatcccttcttttcgtaaagccttgaacagttcttgaccatctatgtcaggatgttttacaaatataaaattagcataactatcaggaacaataaagcccaattctttcagtctttgttttgtcatttctctagttttaattattttagcacacttagctttagtatcttgatcatctaaaatacttgctaaagctatttgctgggtaatgtaatcgattggatatgagttaaaagaattcttcacatcatataaatgactgattgcctctttatttcctagtgcaattcctaagcgaattcctgctaacgatcttgattttgaatatgtttgaatcactaccagattttcatatttattaattaatggtacacagcttttacctccaaaatcaatataagcttcatccacaacaacaatactatcaggattattttttaaaatagtttcaataaaatctaaatcttctaataatcccgttggtgcattaggattaggaaaaataattccactatttgcttgtaaaaaatcattaacattcattttaaagttatcatcaagtttaactaactgataatcaatttgatatagatcacaataaacaggataaaaagaatatgtaatatctggaaataaaacaggctcattcccattaaaaaatgttaaaaaagttaacgctaaaacctcatcagaaccattaccgataaatacttgttcctcatctaaatgataataatcagctaaagctttccttaaatcaacagcatcgctattaggatataatcttaacttatcaatatctatattactaattacttctttaactttcggactcggtccataaggattttcattagtattcaatttaatcatatttacaatcttaggctgttcacctgccacatatggttccactttacgtaatttatcttgccaagtcatttaatttcccccttaaattatttctgcaatcaactctgataaattttcaacctgccgataactatatttcttgacttcatcacttacacgattgaaggtataaccataatcagcatgctcaaacatactaatatcattatatgaatccccaattgcataactaattaaatcaccattaattaaattaaccaaattagtaattcctgttcctttagtacaattacttggggtaatatctaaataatgttgatttaatgttccttgagcatcactattataattttcagcaataaaattcttgatttttaaaacattatctaattgttgatcatcctgatgtatcgctattatatcaaattcttttgtctttgaatattcctttaaaaagtcatattctttaacggcaatcatcccctgagcactatatctatatgtttgattacgataatatgccaatgtcttctttccatcaaaaaagtaaacccacaaattattatattttaaacactcttcaataattctaactccaacttgttttgaaattgcctgtcgatataaaatagcctcatctttattcatgatttgagccccgttatttaaaataagataatcataagctaagtcgtgtttattaatttcgcccctgacctcttcaatatttctaccagtattaaaaacaaatatatttccagcatctctaaatctttttatcatttctttatcttttgaataaagtaatcctgattcattaataatcgttccatccatatcacaaaacaaaatttttttcatcttaacctcctaaactagatcatcaaataaatgataaagtacttctttacttttattagtttcttttaaagcttcttctattcctttagctataatttcactgttttttaaacaaacacattgaccactttgcctttcaagcaacagttcaattgctttaccagccattcttgaagctaaaatgcgatcttctggaactggtgaaccgcctctttgaatatgccctaaaacaattgctcgacttgaaaaaccagtttcttgattaattcttttagccaatttatcaacatcaaaaattttttcactagcaatgataattgcatgccgcttatgataaacagtctcattttttatcatttcagaaataacaaaatcttcatcatatcccgttttattagtaataactaattcactgccacatgaaatcgcagaataaagtgccaaactatctgcattgtttcccattacttcaattacaaaacagcgatgatgtgaacttgaagtatctcttaatttatttacagcatcaataatatttgataatgcggtatgaaacccaatcgtttcatcagttccattaatatcattatcgatcgtccctggtataccaatacagtttattccttttttacttaaagctaaagctccacgataactaccatcaccaccaattacaacaagactatcaatgtcaaatctttttaaattttcaattgctttatcttgtacttcatccaatttaaattcaggtaatcttgaagatcctaaaatcgttccccctttagctaaaatctctgaaacatcactgtaccccagtttctttatcttcccttctataagtccctgataaccatcatatacaccataaacttcaaaacctcttttaattccaactctaactatcgctcgaattgctccattcattccaggagcatcaccacctgaagttaatactgcaatttttctcattcctatacccccaaaaaatttttatattaatgattatagcataatcattaatgaataattaattatttctaatttaaaaaataaaaaattaaattaattattattttttaaagtaattctcctttttagattgtaaaagataatgaggaggaaaaaatatgattcatgaaaaaactattatcgataataacaataatgttcgctttagtaatgacctgttctttaaatacctgctttccagagatactttagaatctataaaactgagaaagtttatcgttaaatctgtcactcatcttgactgccaacagatgatcgttaaaaatcctgaaatcaatcaaaatacggtccccgctaaaaatatcatccttgatatctgtgcggttgatgaaaagggccgaatcattgatatcgaaatgcagatggccggcaacagtaatagcgaaggcacccgctttcagttctatggtgctagactgttagtagaacagatcgataccggtgaaaaatatcatcagctaagaccagtatatcaaatcatctttatcaatgaagatgatgatcgtttgatcaaagattatgcgtttcgagatgatcagggagagctggaaaaagaaaatcttaactatcgctattttatcaagatgagacatatcgataagatcatcaaagaaaaaggaattgaaggattaaatgatctagaaagattatgttatttgtttataaaaaatgaatacactgctataatgaaggaaagagaagaagatatagtggagatggtgataaagatgtatgacaagtttagaagtaatgagccgatatggtcattagcgaatcagttagcgttagcgaagcttagaaccgaatccttagagatggagcgcgaagaaaagacagccaaaagaatcgaagagggaatcaaaaaaggtatcgagcagggtatcgaacaaggtattgctcaaggaattgagcaggaaattgagattggaaaaaacgcaattctacaaaaaaatagagaaacatgtattagaatattaaaaaagcactatcatattgattgtgcgaaatgggttgctgaattaaacgaaaaacagctcgaaatgatatttgaatatgcctatgatgaagagtttgaaactcttaaacaaaaaatagataatatataaagagccagcattcctttacactctcaaaaccccacagttgaccaaagttatgaacttatcctaaatggataagttcattttgtatattttttatataaaattattttagtgaaaaacacaaaatttgctttttaaatcgagaatgtgtatttattactttaaaagtaatttatgcttttattatatcttcaacaagcatttccaagtatttttaccaacaataccatcaacttgtaaaccattatcttgttgaaagcttttaattgctttttgcgtattattaccatttatcccatctatttcaccacaatcataacctaaattatttaatctttcctgcactaaggctgtaatatttccttgagatttatttaataacaaaggacatccttctaatgtaactgtaccagcaatgccatcaacatcttgattactaaagccttgattattacattctgattgtaaacgggctatccaattatcaatgttatctacttgctgatattcgatataaggactttttccatgttttaaccattttctctctttttgaccattgctaatatttttacaggttgtgatttgtactccattattccatttcggtgtagcctcaattacataaccattacctatataaatacccatatgcccttctatccacactatttccccgacttcaatattactaaaatcattacttacatttaaacaatttgaaataattgtatctgcattttgatctaatacaccatttgatgcatatttaccattttctggatagccccaaagaatgccttttagtaaaccactacaatcccattgtgttttcccatttgtttttttattaccaaatgttcctaatttatattctgtagcactattagccacagactttactttttctactaattgtatagctgtcattatcatcttatttttcttccttattaatcattttatccgcaacctctaatcctttagtaaatatcatcggaatattatagccagcttctactaaattctctacaatacttctaagttcatttattgctagagaggctaacacgaaccatcctaacaatgtcgtaatttctagattaattcctaaagtatttccaatttcaataaacaaaacagatgccaaaaatgagatcataattatgatccaatatcctaatttctttaaaagacccattacccctactacagagtttatcttattactcattttagatttcatccagcctgttatataatcaataacattgaataataaaaaaattgcaaataaaatccaatgttctccaaaaataaaacttagaaatgcgataatagcacctataactgcattatatgtatccatataatttaagttctctaaaaaattcattttttatcctttctgtttttatatttataattatttttatcttatatcattcatctaaaatgctataaagttgcaaagttactctaaaaatttttgtaaataaaattggctgattaaaactatgattatttcccattaatcaataatatatttttaaaactgtagagatataagtatttaaagcacttatatctctacaaaactaatgtaatatgtattttacattagttttataacaaatcatcttacaccataatgattaatctaaaacaatatcctctaattttttatattgtataaaagcaactataacttgttcgaatatgtatatataataatttatcaaaaatactaataggtttccgtttctttttgagctatcaccactccatactacaccttctatatgtactaggccatcactcatttccaataatctttcagatttttgtactttcgatatcagccagtaagaataccatcgtatagttttcatccccaataaaatgtaattctagattttgacatgttaaagcattatcattaatcctctagtttaatggctgtattcatttgcataatttttgcaattagcatcaacctccttctttctttaatttttcgtatacttaattgtagtgtacgaatgattccaactacaaaaagcacctaaaacaatttctacattgtttctattaacaacaacagatgtaccgtcacgtacgtcatccttgtgggcagatggcagtttccagaaattgtagactccagtattccaagcaatacttgtaatatctataaccatatctagatcttcgattccatgtggtaccgttttattttggttggcagtagtacctactatttcacctgtatcgatagtttttatatatattttcttaccatctatccaataattgccagtccattgttcttgactagaatatttaaagtttacgatatttcttccctctacttgtaaagcacctccaacatcaggatcatagaaagcgccgaaggcaacaccattttgatgaattgacatttgaggaatcccgctttgaagtattgtttctttaaaaatacctgtcgttattttatctgaaataacgattttaaaatcataattattttcaatctcaaaaccattggctcctaaatcacctgctatttctgcttcaataataaaattattattacttgcactataagttatttccgtattcccttgtatccatgtaccgcttccttgagccttgtaaaagtactgtatagctagttcattatcaacgtttccaaaattcccattaaaaaattgtcctttacatacaactactgcatttgaatctattccgcctttctctcggtatacagttaattctaaaattgctggtgtaaaataatctataaaattagggattactgattctttacttataacatttcctcgactatcttctacataattaacaatagtattagaagcagcattatttattataaaattgttattttcggtatttctgataacattgtttccgcatattatacgatattctttaattgttgcttcttttacagcgtttgcactattacctgtaaaagttattttagaatatccttttattactgttgtattacctgccaattctccattatctactgttaatgtttcaagtcctgaattccatgtcggatctggattttttatggttattgtccgatcccgataatcaggattaacccactggccattaatgtttgtgtaaattccaacccgtattgtttgtgaatttctagtacatttttgacgaattaattttctttctgcatctgtcaaattccaatccaaacgtccacctgtacatgttctttcacaaatatgatcaccagtaggatttacttccagccatgcttttacccctaaaccaccaggattactataagtaagccagggatcatcttcatctgtaaaattttcaatcatgcttgttaaagttgcttgtctaggaattgttggaagagaccacgaaccagtcacatcttcgtttactgtatttgaataaacagctgcgacaacatgtgcactaaaattaaaattaccatttacatcatgatatacagtttgatatccatttgctaaatcacctttatatcgttgtgtacgactattattattaaccagaactgcaccaaaagcatcacaataatctctatagtgataataatatgatgatgttcctccaacaacagttacccgccagtaaattaccgatgaattagtagcaatatcctgacttaccagcgcccatgcaaattccagatatctgccctgatatccaccactgcctaaaacaccactattcgccattttcatatacctccacttcattaggattgattctattaattattgtttgatcattaatattctgaatcagtaaattaacaatcgctgctttattcttgataacagctgtgtttgttacaataccatcactatcaaagatagttatatattcgccctgtttattcatgaaaccaataatatccgcaagagccacaaattctacatcagtaccaatagaagaaatacgaacacctcgaccaatcttgaccgtatccgaccaggtttcattagagttaagtgaccattccattttttcatcacctttattcagcattagatttatgattggacaggcattatctgtatcacattcaaatacgatcgttatataaccgtctgatatttcaaaggtatgtttaaattcggtatagtcattattgcttaaaacaaattcatctccattaataagcagcttaacattagctaaattaaccagttttttataaacaaaagacaaagtatatacaccgttggcaacatttacctgttgctttaagctattattttttaataataaagcatagccatactggtttctgtagcgcgtttctgcagttgcatcaagattgtaatttccttgccaagaaccatcattaaaacagccgatactatctctaataagattattactacttgtcgtttttaatgtattagttaaaccatccaagcctagaatcatattttctactgtttcttttacttttgtttcttcaccattgatttcaatagttgaatcttttaccaaagcttctattttaccttgttccagttctaaagatgtatttagacttgatatctcaccttttataaaatcaatatcaccggtataatcgctgatagaaatccagctattatcttcgtagatttttaaaacattaggataattagaagtatcaagccatttaatgttatttacaggattttcaggttcaacatcactgataaagatattattgatacttttgtattcctcaaatgcttttattattaattctccctgttcatttaaataaaaactaggatcaacaatttcaccattattattacgtttaccaatttttattgttcctaatattaaatcaagttcaaacatttcaccttgtaacacccctgtagttataacatttgcattaaaattaccctctaaatcaaatgctatatttttaaaagaggatcccccatcttcactataacctaaaccaccagacgtgaacttccataattttgtgtacggctctaaagtaggcgtattcatgatcgtccagccactaggcttaccatcatcatttacatcaatgactagattaccaccatgctggcctaatattgtttcactactatgtttaaaagcatttgttaatgtattataaagtttatttaacttaatttctgtaggacttgatgtcttcattactaatcgttatctaacttcccaacacattcaatttcactgctaaaaccaccatctaacattaatgtttgcttcattattacaatatttttatttacaagtttaattacgtcactattttcaatactaggattaccacgccatttgaaagtacagggctgatagctaaaaccgttgacttttaaaaagattttattaagtaattcttgagtcatatatggattagcaaaactaatcccattacctgatccacatgtatatgtatgttcttcatcaccactagtcagtgaattaataacaaattcactttctaaagtctcttggtagctatcttgataaattaactcttcattaattattaaattagtattactataccaataaaactccaattcaccaaaacgattaattcttgcattacatcccattaaaccagctaaatatccaagtaactctttacatgaaatattttcataataatgattaataatcaaattttcatactcatctaaatcaatttctgccaatacaacattacactgccttaaaagatcatttaagacatcaataaactttgtttcatcattaaaaacaatctctggttcatatatatcatcaaatcttttcatagcatcatagccattcaatttaattgaatattcttctcgagatacttcatttacaatatatgtccctaaatcgatccactcaatttcatcactaaattttaaaccacttttaaccactatttttgcctgttcaaaagaaataatctcttcaggaataaacatttctaattcaaatgcattactacaaacatctccaattgaaatcacttcaccactacaactaatttcttctatcttaatacttttaagatatttactatcaatttcctgatcattaataataactttagttacaaactctcgcattggagaaataatcgcatttttatattcactgcttacattcaacattacttattcctcctaacgctctataaattctattgcaagtccctgccataaccattcattagcatctttatcaaaacaatagacaggtaccgtacgatcactaacataaacattcattgtcacattttcacctgctttaggatctggatacgtaatatcaaaaaatactggttcaattgcttttaatatctttgacatttcgcttgtaagcatcggcgggaaggtaacggcaagcttacgctttaccgttattcgatctctaaacatatcacctagtacattccttcctgaaccttcactactatccaaatctgattcctgccattgtaaagaactaggattaacaaacaaatcttttccaatttttaatatttccatttttttcaccacctaaatcaataatgggcttctacccgtttgcataacttctcgattatgcgcattaatcacctgtttagccacttgttttccatcaacctggaagattgctgtaactgttgtattagcttgatgacttctcgacatggcactaaccatagcgttataaacaccagaactaattcccgaaactatttgatcattattagcaacagctgtcttaccatttattcgtcctactaactccggccctgcttcccgtgcaataaacaattcacctgtatctacaaaacctccagctgctttatgtttaacattatttttgacttgattttctaatgtatccattactaatgttatggcagccttcattccaacaggcaatttcatttcatctattttttttcttgtagtagatatcatatctgttatagcatcttcaccaggaccttgtgcctcaaattccaattcaagttctgcattttttgctaaaacctccatttcagaaatgatattctctgtttctgaagaaattttaccaccgttttcagttatacttcctgctaatttattgcataattccacaccaccttcaattccactatctcttaaaatagtaatcatattagttagtctagatcttgtttcttcattcattccatcaagacctgtagataaattattatttaacattgataatgtttcatcaaatatttgtgttttttcaatacccttattcttccaaatttcacatccttctattaatataccttcctgtgtactattaaattcaatcccagcatcttttaattttgttaaaagagtttcagtatttaaagcttgaatttcttccttggtttttgcatttcctgcccaatttaatatttctgtatttaaaattttttgttgctcttcattaaaaatcccactattttctattaactgggtaagcatattatcaaaacctaatttttgcaattcttctctacttttaatattttgcttatgattttcatattgtttttcccattcttctagttctaattcagataattgtgttccctcttcctctaatattgaaatcattttgtcaaatgaataaccatatgcatctgctttagcaaaacactgttgcctaattaattcagaagttttagtatttaattcaatttctttactatctctacttaaaccgttttcaaaatattcttgttcttgaatatccaaattttttatagcatcagcaagactattccagcttgatgttcctctattgcccatttctgtatacatttcagcttgtagatgagccgttgcttcaatatttccatctaatgattcatacgcatatctacacatatttataattttttcattttgagcaaattgactctgggcttcataaagaaccttattttgttcctttaaattattttttgcatttattatctcaagataatattctgtagtatttccactaccactagccattgccatttgatatctgttttctgccgcagtaactgcatccttggctttctcactagctttttctgcagctgttaattcagcttgatatttagcacgattttttaaggcttcagcagcttccttttcataagattctaatactgctcttctttctaattctttaatgctagactttattgcttctgcattttcttgaacagttttagtactatctttccatgctatttttccatcctctgttaatttaacactttcaggtaaaacatcattaatttgtttcactaaatattcagcttttttaagattagtagcatagcctccttccccagttaacttaactaactcgtctacctgtttaagagtaaagctataatcattttgtatcgaattagcattatttaccattgcttcagaattctttttcatttcttcagtgttatcacgtaatgcttctctttttttatttaatttttctacatatttttctgttttatcagctgcttcatcagtacctgtaattaaagatccaataaccgtcaccacacctactactgctgttgctaccgcgagaaatggtgtaatgtttgaaataattcctgttaaacttgataatgcaggtatacaattacttacaacatttaatatatctgttaaatcacttttcaactgattataaccgttaataatagtagtaatattcgcaagatccccaaacgcatcactgattgagtatttgcctaattctttgcttacttctgttaatttacttaattcatcgtttatactagataatgatctattcatattttccaatgtttttgtagaattgataagatttttatatgatgtgtcatccataaacacacctcctttataatatttgtttatttttataccttcctagtttataatttacttataataaggaggtatttatgaaattatttcgttcagaagaagaagtactacaagatgagaagaaaaaccaacaaagagaaatagaaaaacaagaagaagaaagagaattaagaaaattttatgaagatataaattttactaattccgaagaagatctcgagattttagaacaaataagagtacttataaaaaaagatactttattttctttaaatcacatatcacatgctacaactggagctatatttgatagtataactagatctacatttcttgaattttacattttaaaacaattatctagtagtagaaaagctattgataccctagtaaaacaaaatgaagaattaaataataaatttgatcagttaattgaaatcttaaagtctaaatagccatctatataaaagggtcaatgaaatcaacttaaaaggttggctcttttttattatgttatcttctttaacatcttattttctagatttgaagtatataaatatcatagctttaaattaaatgaaacaaataattagtttgatatttactcatgataaaatttaatagtatttctactgcattaccataatataaaaatactaaagaggaatgatgatttcattcctctacttgtatgcattaacccaattttccatccatacttttgcttttgcgcgttcacgttcaactgttttttcatgatctttatctagctgctcttgattaataggataaggttttgaagtataggaaactgcttgttgaccagctttacgacagaatgcattatagattgcggtgctaactgcatcatatatatacattccttgaagccatagttgattgttatcatgctcattttttatttcataagcttttcgataaactggggctaaagtaacgtcttgattgtaaaactgatcaaagctcattccaatacttatataaaagggtaatacttctttgaatatttctgtataagttttatcttgcgtggaaagttcttcttctagaaattggctttccacttgatggcgttttttgaggtattgtcctcaaataggtatttagtgtatccattgccattgtacttaatttattgtacatttcatttttatcagtaaataattcaaaaatttcttctaccaatgatttagtaattcttttatggtgagcaaagaaagcgtattgaaataattttggtagaattgtcactggttttttatctaattgagctaatacaataccatctgcttccattttttctaatgtttttcttgtatattcaagagtatagtctacatctttatatgtaaaattaattactttagccactgttatttcctcctaaaattaagctgtttttgtttgccaagttggcgcatttgttggggtgatatataaattagtttctaatacactattaactgccatcgctggtagtcccatagcactaggttgtcctgtaaagaatacagatttttctaatcctggatgtttaatttcaaaccatacagctttatctgcttctttagctgttttataagcttctactaaagtagcccaagcttcttctaattcagtagtgaaattagctaaaaaagccaatgcccctcctaaatcttttaacccttctacatatgttttaaattctgtttgacttaaatcagttgtttctaaagtttctggagatggattcatctcaggtactgatttaattgatggaattttaatatatcctgtagttggtcttgttccagcagtagcttctactgcgtaatttaccgttacaccggctgtactcattgcgattgctgacatttgtatgtcctccttatttaattattaatttttcatattttactagtcttctaatatcattgatttctttatcgtcaatcaaacctaactgaattcgtaaatatccaaattcattcattttttcatcaatgatagttataattgttttaatatcatccattcctgattcatttgaatttgctatttcaaattcaaatatttcattacatacgttttccaattgatcaaatgtactatattcaggtactacagcatcatttgttaaaacaattgaaacagcaggaaacactgattgactattagacaatttttgattggtaatcattacttctggataagcctctttaattttttgacttacctgatcatatatttgctgctcattatcattcatatataaaacacctccttcatcaccatatttaccctttttgaagttatcttttaacttcacatacattgtaaaacataacttcctaaaagattcgctcccttaatcaacaactatttttctaaaatctcattctctctatttttcatccgtcgcaaacatgattattcatataaatcttttcaaaagatctaataatttcatcatttattataataatctattaattctttttactaaacaaaaccttaaacatactttaattgaatatatttataaatatttccaacaataaaaagagatatctaattgatatctcctttataactacattttatttgtctgttcaaacaatttttttaaaatgatattagtcttattcctaatcccactatcactataataatatttattacccactttttccattttttcatgtttattaattaaggcatcattaagaatatcaatttcttcatgttttaaatcactatctttgataattttatcaattactaacaaaccattttttataatttctttctttttaagatcatttgattctgttaattcattttgccaaagtatattaagctgtaataaacatcttaaaatttcaatatcatttttcataaacgattttctctactttcttaatgattcttcttaaatctgaataatatttattttcactaatatttgaattcttaaataattgctttttaggaattttatttgaaaaatgatttaataaaaatgtaatctcttcttccgttaaattatttaatatcccctggtaataatccaaataatcttttaaaacattatcaaaatcattttctaataattcttctttttgactaatcaaaacatacagcttaatttctgtatcaataaattttttttcatttccctatcctctcactttctaatattattatagtaaattttatgtagaaagatttactttctttttttatacctaatcattaaaactgttattacctccccttccatattagataaactatatcagtttttctaacaaaattcttatatctatattttgcactatttttgattttcatgctttgacttaccccctctataacaccgataaaacggtgttataattaaaaagttaaattttcttattttttgataacacaaaatgtgttaaaaaataatttaaaatcactttaagtgtatatttcgatttttcaataaatattatcctataatacataaaagaggtgatatagtgtctaatataacaggtgaaagaatttcatacttaagatgtgaacgcaatttaactagagatcagttatgtaaaattattggtgtaagcaaaagaacgattgttgcatatgaacaaggaacaagagaacctagtatcaaaactttacgagcgctaattgaatattttaatgtttctgctgattatattcttggctatacaaataaaccacttagattagatactatttgtaaagaagaaaaatcttttattctcctccctagaacaatccaggaatcccaagcaaaatataattctatcaatgattatattagttatattgcaagcaaaagagattaataaaatcaaaaacttaatttttgaaaaatattatatttaagtataaaaataaaaggggaagatcttatcataaacaagcatcaattctcctttttatttcattataatacaacaaaaaaagatctgttgagagtacgaatcatcctctttacagaccttttattttaattttccaaatcaaatcttaaacaaaattcaattatattaagttatctaaattagcttttgctttatacgttattttaaaacgataaccttcacttgctgcaattactcgcattgatgttttagaatcattactagatgcatttacaccaataccataattacctaaactattgccacgttcattaaaatccttttcaagagcattgaatttatcaccagcgctattaaaactattgtactcttgatcaccatttactaatgtaatgatttctttaaataatggataactatcttctttgatctttaatgcttcaaaatcttttagatcagtcgtattttgactgataattacattattagtttcaccagataaatcataattaaaatcaattgttatctcataagtatcagctgttaattgatattcaagttcactataaacattattttgatcagttacgtaaaaattataatctttatcaatttttatttcaccatatttatcagtaatattttttaaatcactttcaagcttctcgattttttttacgtatgtgtcactattagtcactaatttttcaaaatcagataatgttccaaaataatattttatttgttcttttttaatatcaacttctcctaacggtcctaaagtaatcgtattttcaggtgtactaatagtattttcagatgttgctgtttcttctaagaaacttccaaataagaaggttgaaatcattggtgaaaagatcaagaaaagcgctagaataatatacatagtgttaggaaaagcatttgttcttttcattggttgataacctttttctaaccgatttccacaatgaggacatactttagcactattaggaatattttttttacaataagggcattgtttcatttaattaatcacctactcatatatatttgacatccaggttttaaaatcttcaacatatttttctttggcctgttcttttttcttactatctttaatttcatagtaatcttcacttaaataagtatactcgctaattgtttcacctttattaactaatttcaaagtaggtgtccaattaaaatctaattctttacgaatattttcataaaaatctttttcttcttgtgtagcatcttcacttttggcagcatctctaaatgctttaatatttaaataataaagatatgtaccctcattttcttctaaataagatgttaaaattggttcaaattccctgcaatctccacaatcaggtcgtccaatatacaatacaaatagttcattactacttaactttgtttgcaattgatcatatgttaactcatggattcctgaaagtgatgaatctttttctatatgattagtggatgcttgctggcatccactaatcatcaatatacataaaattaagataaaaagttttttcattacttaattaaagattctccagacatttctacaggaatttctaatcctaataattgtaagatcgtaggagctaaatccccaagcttaccaccttcttttaattctaaatgagagtttgttaaaatcaaaggtacttcattagttgtatgtgcagtaaatggattgttatcttcatctaataacatttcactattaccatgatctgctgtaattaacattgttccacctaattcaagaactttgtcatatacttctccaacgcattcatcaactacacttacagcttttatagcagctggaataattcccgtatgtccaaccatatcacagttagcaaagttaacgatcacgacatcatgaatatctttatctaattcttcaatcaatttatcctttacttcataagcagacatttctggctgtaaatcatacgtagctacttttggagaatttacaagtacacgtgtagctccctcgatttccttgtcaacaccaccatcaaagaagaatgtaacatgagcatatttttcagtttcagcaattcttaattgttttaagccttttgctgataagtaatcacctaaagtatttgttaattctggcaatgcaaaagcaattgaaccatttacactatcagcatatttcatcatacatacaaatgttaaatttttaggaacattgttaaaagtgtaatcatagaaaccttcattagtcattactgttgataattgaattgctcgatccggtctaaagttagcaaagataattgaatccccatcacaaacttgaccatcaacatttttgttataacctggaattacaaattcatcatatgtttctttagcatatgaatcttttacatactgtactggacaatcaaaattttcacctttatgattaacaattgcatcaaaagctaattcaacacgatcaaatctcttatcacgatccatcgcataatatcttcctgatatagttgcaatttcaccaacaccgatttcttcaattttatcagctaattcttttacaaaatcagctccactatcaggtgctacatcacgcccatctaaaaaggcatgtacatatactttatctaagccctcatttttagctaattttaataaagcataaatatgttcatttgatgagtgaaccccaccatttgataacaatccccaaatatgcaatttagtattattttctttagcgttattaattgcttttaaaaattcagtatttttataaaattctccatcttcaacagctttattgattaatgttaaagattgataaactgttctaccagcaccaatatttaaatgtccaacctcactatttcccatttgaccatcaggtaatcctactggcattcctgaagctttaattctagttgttggataaatcatcattaaatcatctatatttggtgtattggcaagttttactgcattaccatcaattctgtcacttaatccgtatccatctaagatacataaaacaattggtcttttcttcatcattttaatcctccgttttcatgaatcattataacttgtttacttataataatcaaatatgaaagcttttaaaaataaaaaaattagtactttttataatactaatttcattttttcttctttttaggagtagttataatatacattccaataaaacacaagatcaaaggccaatatcctttaatatagtaagctattgtagctacgattccttgaaaatctttagtcctgtccatcgttaaaatcattcctaaaaaaactaaaataatccccgcattttttcgaaaatccattttcatcaccactatcatcataacaaaaatagtattacgaatttgtcgattaacgaatagaaaataactattcgtttcattataactctttccttcttgacatcgatttcaaaaaagatcatttgatcctttattttttattcagtctccaacgtcaaaatacaaacttgacagcagatgtcaagttttatttgttataatatagctgtaaaataactttggaggaaaaatatggataaacagtttataaatttaacgaataattattatttttgttgtaagaaatttcaattaaaagaatctgtaaaaagacaaaaatacattattcacaaatccgaaaaaaacttttttaaatataattcattcatttctaattacgttgaacagatattaggttatgtaatcaaaacagccttgaaaaaatttaattcattgaggataatcatatgcactttaaaaatgtaaaaggaattttgtcttcgtcaaataatatgaacttatatcgcggctgcttacatggctgtatctattgcgactccagaagtaaatgctatcatatggaacatgattttgaggacattgaaatcaaagcgaatgccattgagctattagaaaatactcttaaacgaaaacgaagaaaatgtatgttgagtactggggctatgacagacccgtatattcctcttgaaaatgaaatcaaaaatgttcgaaaagcgttatcactggcatatcagtatggctttggatttactttaataaccaagtcaaaccgtgtactacgcgatttagatttattgaaagctattaatgaaaagaccaaatgtgtcgtacagatgacattaacaacttatgatgaagatctatgcaaaaaaatcgaaccaaatgtaagtacaaccaaagaacgcgtcatagctttaaagaagctgcatgaagcaggaattcctactgtcgtttggctttgtccgatccttccttttatcaatgatacagaagaaaatattagaggtattttagaatattgtattgaagccaaggtttgtgggattatctgttttgaaatgggagtaacacttcgtgaaggtaatcgggaatatttttataagcagttagaccggttatttccacagatgaaagaaaaatatatccaaacttatggtatgcaatatcaactaagcagtcccaataatcaaaaattagtgaaattatttcatcaattatgtaaagataatggcataatgcatgataataaacagatatttgcttacttaaacaaatttgaaaataaaaataatattcagttgagcttatttgatcaactataaaatgcagtacgaatataaaaacagtgtgtaatattttcttaaatacacactgttttattataattttagttttttatcagtttttaatctttctttttttctttaagtaatttatctttttctttgatcatataacttaattcttttccatataaaacaaaagacaataacattaaagcactgctagtaataatcataattgaactaattatagtatcaggaatatgcaaaccaatcaagataatcacaacaacataaaaatacgccgttgcaatctttccccaccaggaagctcctttgattttcaaaccataatcatataaatataaaccaacaattcctaacatcccatcttttaaaactattatgatcaacacaatccaggcaagtggataattgaataataaagtcactgcaattgtaaattgtgtcaatttatcagcaatgggatcaatcaatttaccaaaatctgtaaccatatcatattttcttgcaataaaaccatcaagaaaatcacttaatccagataatactaaaacaaatgcagcaattgcataatgatagtcatattctgatttaaaatatacatataaaaatactggaattaataaaattctaaaaaaacataaacaatttggtatattaaataagttttctttatttttcatatccataaaaatacctcttttagcttattataattcccttctataataagtcaatttattttataatttactaactactaataaacttattcgataagaattattgattacatatacttctataatctatgctgttaactaaaataatattatataataatttttattcttatttataaacttttttgcatcataatatgaagacaccattcatcataatacggttttccaaatacttgatagcccattttctcataaaatttttgagcctgctgctgtgctgacaattgaactgtcaaatatcctaattcgcttgcttttttttccagttcctgaacaactatacgaccaaaacctttttttctataatctttgatcgttgcaatacgacctaaaatcattatcttatcatctttaggatacattcttcctgttgcaacagcctgattattttgataaacaactaaatgataagcaaaatcatcaatctcatcaaattcattttcaaaaccttgttcttcaacaaatacacgttgcctaattattttcgcatcattaaaatcaatcttatcataactaattctatattctaaacattctttcatctttaactccttaaaaaatcaataattacatcatatactttttgtttttcacattcattcaatatttcatgccgcatgttatcaaacaacattgcatttatgttctgatatccatcatttttaagtaaatcaacagcttgataaaaagctttttcactaataatacaaggatcttcacggccagaaataaataaaatcggtagttcatcattaataggataagtcttcttttgataagtctgttgcattaaagcaagtaaattataaaatccatttaccgtaaaagtgaatgtacataaaggatcatcattatactcatcgactactttactatcactacagatccattcattcgttttttgataccctttgttaaaggtttcaaaagatatcttttgcattaaacgactgtgatacttatcacccttaataaccatataaagtttacaaattgctttaccaatactgcaaaaacgattatagcttggactcccacacacaatcaatccgtcaatttctcgatcatattttctaatataattccttactactaaagatcccattgaatgtccaaatagatataaaggtaaatttgggtatctatttttaatatactgacttaacatataaacatcttcaacaatagctttcgcaccatcattataaaaataacctagatcacttttatctaaaacacttctaccatgccctcgatggtcatgaataattacaatatatccataactattcaagtattcaataaaatctaaataacgttctttatgttcacacatcccatgaacgatttgaacaattgctttaggtttattacaatcagaaataatgacttcgagagccaaattatcatattttgaattaatttttatttgttccatatcaacacctaataaaatcataacatccaaaacagctcataatgactgttttggataacactattaatactctaaaaatataaaatcatcacattccatcaatattaatttaatattcttttctatttcatttgttcaatatctgtttccgttatttttaatttccgcttttttaaaatcatattaacaagttcactagctaatgaatataaacatgccgcgcaaggtactgcaataaccattccaaaaatcccaaaaaaatcaccaaaaacaaaaatcgaaagaataacccaaattcctggtaatcccacggaattaccaactactctaggataaataaaattatcttctaattgtgataatatttgaaaataaatcataaaccaaactgctgataatgcgtcttttgataaaatcaaaaccgctccgataaacatagctgcaattggtccaaaaaatggcacaaaagaaaataatgcaatgatcgtagcaataagttcaggataaggaaagccaaataaacgcattgttatgtaatataaaatccataagatagctgcttctgttagctgtccactaataaaattagaaaatacttcattagttttatgcgcatatttaaaaattattttagttacatgatatccacatactgctccaactacttttcttaattgtcgtaaaaatgtttctttatctgctaataaatataatgagaaaataaaaccagtaaatgcaatcccaaatttagataaaaaatcagttgcattggccattatcccaccagcgcttttagataagatatttaatacttgcgaaaccatttcctgccaaggcatattgatcaattccttgacacttccaatatcttccattctaaaatcaattccaaaataaataaatatctcatctatattatcaaatatatttattaaaaaagatgaaatattgctaatcaatgaagttaaactgcttatcaaattaggaataacgatactcgctatcactatgatcaacaacagcattaatattagcgtcaaaattattgctagagctcttttttttcgataaataaaactttcttttttacatttctttgcaatcaaagtttctatcagcttcattggttgattcaagatataagcaatgacaataccataaaataaatattttatagctcctataaattctccaataatagcccatatactattaagattgatcaagaaaaatattaaaagtactgtaaatgctgctatgatcattcctggctttacttgtttttttagatcatcattaaaaaaatttcgcataaatttcacctctgtattgtcttattatagcatattaattttgtaataatctaaagaatacaaaaatgcagttaaaaaactgcatcataaatcctattactaaaataaattattccatggcctattccaattccaaataacatccctgttattaatctcaatagattattacttgtatacggtgtcaataactgtaaaaaaccatcaactatcattggtacaattaataaaaaataatgtattttaggtttatgtttatttaaataatacaaaacaaatattatccccaaaactaccccactacaacgataacataaaataaaacaaaaattacctatatgtaatgcacgagaggccattccattacaaataggtattttacctatttgtaataatcgctccaatattatttcaaccattgtaaaaacacatcagtttcaactggaatattttccataactcctgtaaattcatttgctcttgaaaaagaacagcatgcaaaaattacccatattaccactccagcaataattccatataagcacgacttagcccttttaggatattctttattccaaacaatgaacaagaccaatccaataatcggaataaagaaacttaacagcgcatatccaaaactaccttcatcaccacgaccattttgaccacttatatttaccccacattcaggacaatatttagaatcattaggaatttgtttcccgcatttattacaaaacattttctcccctcctataattaatcacttattactatatcaattagcatttctacaagttcactactaacaatatcgtattcatctccattaaaactaaaatcaacttcatcccttcttgtagtaggatctaatcgccaatctttacatgaactatgcacttgatcaattcctgtataatccaagaattttttaacatttccggcattaattccactaccagctaaaatctcaatgctattaccataagcatcatataaatatttgatcatttctttaccacgaagagctttactttgcaatccactagtcaaaacacgatcgacacctagcgtaattaaaatattcatagattcatcaatgtcattaacacaatcgatagcacgatgaaaaactgcagttttatgatatgattttataatattgaccatttctctagtttgtgaaatgttaatatccccttcttcatttagacagccaaaagcaataccatcagctccattatctaataaaatttctgcatctaatttcataacttcaaaatcttcatcactataacaaaaacctgctcctcgaggtctaaccatacaaataacttccaaatctgttttttctttaacttttaatagagttgctaacgatggtgttaaacctcctaaatgtaatgcactatttaactcaattcttttagcaccaccatattgagcttgcaatgcatcataatagctaccacaacatacctcaactactttacccataaaatcgcctccataactttattatagcacttttatatttgtattgcttagaatttgctttttatttctataaatgttaaaatctaaaagggttttatataacatatatgtacatcatcttttaagggcgaagtaaagcaaacctcttttgatcgataactagatgaaaattgaatagatttttaaaatgtcctcgtacctcagcaggatagagggtccgcctcctaagaatatgttataacgaccgcctttcgggcaaaggcgattgacattgagtaagtttaagactaaaattgaatagattttaaagatgtttccgtagctcagctggatagagcgaccgcctcctaagcggtaggtcgggtgttcgaatcacctcgggaacgccaaaaactccgccggaaaacccagtaaaatcaagggtttccggcgttttttcatttttacggaaaaagtgaaaaatcgtaaaattcacagattttcattagcaaaatctccgtcagctaatggaaattaggacgaatgtcgtccgcctttcaggtgaacgacttgctaataaaaattagcaggattttcgctattttgctaatgaaaatgccctctctgctaatggcagaaaaattcgagcaaaattcctgctaatgaataaggcgttcgttaccctgttaattcgttcatttaggggtggtcaagcgacaatcgcacactacttctatgccatttcttattatataattgcggtaacaggaggtggttgttttgaaagaacaaaaatatcatttatacctttccaaggacgaatacagcgaagtgctgcaatcacttatccgtttgaagaacagcctgatagcacaaggcagatacacggacgcagcagatgatattatttgcaaggtgctttcagccaagaaaagaaagttcaaaatcaaatatatctgaacacgaataaagaccgcctacacttttgtaagcggtctttgctaatttagagtaagttagacaaactggaatttattaggcaaacagaataagtgcaacacctgtgataagcagaactataccaacaacaaactctatcattcccactttctttgcgtattcttctttcttccgaccggctttgaaatccgcctcaaaaccgttgataagattgtatttctttttaaagtaaatgaagtatccaaacagaaggaatgccaatcccagaactacagccaatacctttaggaatatcatataaacacctccacaaaaaattcaaatttgtctttctcttaatttcctattatacaccaaaattatgaatatttctacccgccgtctattgacctcaattaagaggaaagtaggtggctttttttgttagcaaaaaaattttcaagaaattttgaaaaaacaccccccaaaaacgctctcccatttcaaacaagtgaaggggttaattccgagccacgaaaaggtcagccctttcacttgtattttgacaactgaataaaccattcactaagactttaattctgatgattttagccaccttatcgggtacgccgtgacttctgcattgcagaacagcgagaactcccggtataggtaacaggttgcccctgttacggcgatgacagtcagaaggataatgatacttctctacggagctggcggagtacccggcagaggtgaaattcctatgatacagattagcagtctgttccttagtgacttcccgtgagcttattgctcggcaaggggtgttgagaacaaatattgcccgaccggttaggaaatgagccggtcaagtacatagccatactgcgatggctatgaatttcacgaaaggaggacgcacaaagtgtcgaactgcaaaacgattgcgatatgcaatcaaaaaggcggagttggaaagacgaccactacggtaaacctcggcgtcggtcttgcaatgcagggaaagaaagtgctgctcatagacgcagacccacagggcgacttaaccacttgtctcggttggcaggatacagacaacttgggtatcacgcttgcaacgaaactcacagatgtcataaatgaaacgatgaatgaccctacggtcggtattctgcaccacgacgaaggtgttgaccttattccggcaaaccttgagctttcagcaatggagtttaaccttgtcaacgcaatgagcagagagacggcattgagaaactatctcagcgaagtgaaggagaaatacgactatatcttaatagattgtatgccttccctcggaatggtaacaatcaatgctctatctgcggcagacagcgtaataattcctgttcaggctcagtatttaccggcaaaaggtatgacgcagcttgttcagaccatttcacgagttaagaagcgtatcaatccgggcttaaagattgacggtatgcttctcactttggtggatagccgtaccaacctcgccaaaagcacggtagaagctctgagagagaacttcggtagtcaaatcaagatgtatcgaacatatatcccgattgccgtaaaagccgcagagacttcttccaaaggcaagagcatttttgcctacgaaccgggcagcacggtgtcaaaagcgtacaccgaatttacaaaggaggtgttagccgatggcaggaagaaagagcgacttcactctcacgaagctcgatgacttattctcgacgcaggaacagagagatgaagaaaaactttcaaaaatccgagatattcccttgactgagattgacgatttccccgaccacccttttaaggtgcgtgatgacgaggatatggcacagctcattgagagtattaaggaacgaggggtaatcactccggcgacggtaaggcagaaagaggacggcagatacgaactcatatcgggacacagacgaaagcgagcctgtgagcttgccgggtttgatactctccgttgtgaggtcgttgaactgaaccgagacgaagccacgattttaatggttgagagcaactaccaaaggtcgcagatacttccctcggaaaaagcctatgcctacaaaatgcgtttggaagcattgagcagacaaggcaaaagaacagacctaacttccgacccagtgggttggaagtcaagcggaaaagaaacagcacaactaattggagagcagtcgggtgacagtcaaacccaagttcgcagatatattcgccttacaaaccttgttcccgaacttttggaatatgttgatgaggggcgaattaaaatgcgaccggcggttgaattgtcttttctcgatgaggacagtcagcgtgatgtggttgatgaaatcgacctgaacgacgcaaccccgtcccacgaccaaacaatccgtatgcgaaagttctttgaggagggcaagctcacaaccgaagcaatccaagcgattatgtcggaggaaaaaccaaaccaaagggagaaaattgttttgaggggcgatagggttcgacagcttatcccgaagaatattcccataagccaaacggaggattttgtgtgcaaggcattggagcattacaacaagtttctgcgaagcagagccgaccgtgacagccgatagccttccccctttctcacactctaacccctatatataccggctattaacctgctgaaaaatatactctatctcccttgagtatatctatctctaataacatatagctgtctataaaagggttcgcacatttggagcaaaagcaaaatgtctgctacgataaaaagttcagccaatcgcacctttgatgttttgaccggttttgattacgattaaggcagaaaggagcgatggatatgaaaaacaggctgataccttgtgttcttgcctgcctgatgattttcctcgtaggttgtaacggtaacacagccaaagaagctgcacaggagattacgaaaacagagacttcttttccggctggtaataccgaaacagattctcaggaagaaacggcagaagaaccggaaagcacgacagttcaggaagaaacaccgattacggcagaagaaagccaatcaaccgctgaaaggcagacggttgcgactgttcagacaaaaccggcggaagaaaaaacggctgatactcctgcaaccgaaaagccaaaggcagagccaccgaagcagacaaccacgcaggctgaacccgaaaaacaaacggaacagccaaaagaacagacaactgccgaacaaaagccggttgaaaaaccgactgaaaagccggcagaaccgaaaccgacagagccgcacaagcagacattcgatgtcagcccttatgttagttacgcaaaagagtatgcggtaagcatagggctttctcttgacatcacggcgacagaatgttgggacaaccccatatccgcaaatcctaaccgaagcggtatcaagtctgatattgaaagcagactgaaccgatacaagaacagcgagggttttaccgctgtgtggatatggacagaaaagctatccgatacggattacaacatctatatcggctactgctaaaacaaaataattttaagcggacgcactgagtaaaatcggtgcgtttttgcatttcaaggaggaaaacgcaatggttaaaacaaaattcaagaaagccgtctcgcttatgttggcggcggttatgagccttactgcttttacgggcattggggcaacgacagcctttgcagccgtaggagaaaaagccgatgtgtacctcgtcgattatccccgaagcggagataccaataacaacggcgaatggggacacggcaatctcaactatatgaacggttggaaaggcttgtccacaaaatatacaggacttcgtgcaatgggttcgtattcgggcaatattgcctactgtattgaaccgggtacaggtcagcggactggagatactctcaccgaaaaggacgagaacttctttaataacatcagcccgaacggaacgatttccggcgatgacattcgcctgcttatcggtcgtatcttgcagtacggctaccgtggaggtatttcgacaagctggaagtcgcagaatgaaagcgacgcaaactgcatcgcacacgcttatgccactcagattttgatttgggaaacgattgtcggagaaagagacgcaggctttaatcacgtttctaccagcggatacaatgccgtgcttgaatgtgtaagcactgcacacccactccgcagtaaaatcttgtcgtactacaacagtatggtaacaagtgttcagaatcacaccaaagtgccgagcttctgcacaaggtcaagcggttctgcaaaggtaaacgagcttgaatggaacggaagcaagtatgttgctactctcaccgatacaaacggtgtgcttggcaattacaacttctcggcaaacattgacggggtttctttctctgtcagcggaaacaaattgactgtttcgatggagaaagctccgagcaaggaatttaccatcacagccgcaaaaaagaacggtgtccgcagaggtgttgtcgtatggtctgacggtatccatcagaacggaaacggcattcaggatgtggtcacttatgctcaggaggtcagtgaccctgtcagcggctttgtcaaaatgaaggtaagctacggctcttgtcagattgtaaagacaagtgaggacggaaaggttgacggcattcagtttaccataagcggtaacggtgtcaatcagactgtaacaaccgcaaacggcggtaaattccaactggataaccttatgcccggtgtttacacggtaacagaacagtctatcgacaaatatgttccgcaggaggttcacagagtaactgttgttgccggtcaggtgtcaaaggtcaatttcaataatgttctcaaaagaggtaatcttcaggtcatcaaatcttctgaggataacttggttgagggcgttaccttccatctttacggcacatctctttccggtattgctgtcgatgagtatgccgtgacagataagaacggtgttgcttcttttgatgatgtgcttatcagcggcactaccccatacaccattgaggaagtggataccgcaatccgttatgttgtgcctgcaaatcagaccgcaccgattaactggaaagaagtaaccacaagaaacttcacgaacattctcaaaaagttcagcgtaaccgtaacaaagagcgaccgagaggaaggcacaccgcagggcgacgctacccttgccggagcagtttacggtatctataaaggcgaaacccttgtggacaagtatgtgacggataagaacgggcagtttaccacaaaggaatatgtctgtgataatgactggacaatccgtgaaatcacgccgtccgagggttatctgcttgatacgactgttcacaaggtcggtgctgaaccgcagctttatacggtggaacacaatcagacagcaaatgatgttaccgaacaggttatgaaaggcaatatcgccattatcaagcacaccgatgacggcgaaactcagattgaaacaccggaaaacggagcaacctttgaaatctatctcaaatcttccggcagttttgacgcagcagaagaagatgaaagagatgtcattgtctgtgatgaaaacggtttcgggcagacaaaggatatgccttacggcgtatataccgttcatcagacctccggttgggaaggtcgtgagctgatgaagaactttgatgtgttcattgctcaggacggacagacctaccgctatcttatcaacaacgcaaactttgaaagctatatcaaggttgtcaaggtggacgcagaaagcggtaaaaacattccttatgccggtgcaggcttcaaaatctttgaccctgacggcaatcaggtaacaatgaccttcacttatcctactccgacaacgattgatactttctacaccgacgcaaacggacagcttgtgacaccggaaaaactggaatacggcaagggatattctcttgtagaagttcaggctccttacggatatgtgcttgacagcacaccggtgtactttgatgtggcagaggaacattcttccgatgagggtggtattaccgtgattaaggtcgataagcctaatatggcacagaaaggtacagtcagcattgaaaagaccggcgaggtgttttcaggggtaaatatctccggcgtggaaaacgccgatgtgatttatcagcctgtctatgaagtgaaaggtcttgcaggtgcagtttatgagattagcgcagcagaagatattatcactcccgacggtacactccgttatgcaaagggcgaggtagtagatactgttaccacagatgaaaacggacttgccaagagtaaggagctttatctcggaaaatatacggtggttgaaattactgcaccggagggtatggtcatcaacaaagaagctcacgatgttgagctgacttatgccggtcaggaagtgtctgtaaccgaaaccgccacaagctttgtaaacgacaggcagaaagtagcggtaagtcttgaaaagactattgaaaagaacgacatcttcaatatcggcaacggcgatgaaatgaagaatatcagcttcggacttttcgccgcagaagaacttgtttctgcaagcggtacttctattccggcagacggactgattgagattatctcactttccgagaacggcaaggctgttatcaaaaccgaccttcctttcggaagctactatgtaaaggaacttgccaccgatgagcattatatccttaccgacgccaagtatccgttcactttcagctatgccggtcaggataccgcaaatgttgagattgcggtcaatgacggcaagccgattgaaaacaagctcatttacggttctgtttccggtaagaagattaccgaaaacggcgaagcactgggaggtgctgtaatcggtctgtttaaggctgatgaaaccgaatttacaaaagaaaatgctttgatgactgctacctcccaaaaagacggtagcttttcttttgagaaagtaccgtatggcaactggcttgtaagagaaatcgagcagccggagggcttcgtgcttgatgaaacttcttatgaagttaaaatctccgaggtcgctcaggtcattgaggtcgaaatcgtcaatgagtatgttcacggcaatatcaagttgttatttagcactttatattaactagaatttatcaaattattttaactggctttttccattattttgactaattagttatgacaatcacactattttacttattcccgtcaaattacgccaactataatttcaatataaaaagatagtaattttgccttttaacagctaattactatcctcttttaatattaaactttatactgtattctctgatgaaaattcaacgttatgcctggtattgtgctatatgagcgcttattatacttaatccttttgctatcgtcaatccatcaataatactgttcatataacaggctattttttcactgttccagaaaatatcatccaaactgctaagttcactggatactccaatacctggaatatccagccatctcttcatatcaaagttaattacatatacacgatacctgcttccccttgcgcttactgtaaatccagtaattctatcatcgatacttatatcttttaacacacattgccatgaagtgttcttataattacatatataagttatttttttatccaatctcatttgctgcctccattacaatttcattatcaatagtcattttttctctggcagctcctattattaaacaatgagtcagaagattattgagtttgcgtgatgatccctggcaggcattgctcagtgctttaactgcctctggtaatatcaatggctgtgttcttcctgctttctttagtttttcaatgatgtatctgcctatatcatcttcattcattcctgacatttcatactgaataacgattctctgtttcagtgcttcgtgtacagctcggttgattgtatgattaagcactggagttcctgtcatgatcaaaatgacataattacttgaatcaaaattaaagttaagaagcatgatcagatcattgagaatagctgtctttaaatattgtgcttcatccaggatgatgacaggtatgatccttttttcatcaactgtacttttaatatagttttgtatatttctgaagttgtctatttttttatgcattggttcaagtcccaactgactgcacagttcacgatagaattcaatcgtcgtaagtgttgacataggcatataaacaactttataaagtccaggattcagcgattcactaaaacttttcataataaatgtcttccctgtaccacttcttccagtaaaaagtccaatgcccctgatatctttgagatagttgagtcttcctattgcttctttaaagtcatctgtatctatttctatatctggctgtcccttttcaaagggattgaattccatcccatagtatatcttgaaatctttcatagctgttcctcctgtgcaaataaaggcctttttcgttttattcttgaattatcaacctttctgacctcatatatttcgatatagctgtcattttcatatatgaaaacatgacttagatcagggacatatttaattgtgactcttgttccaatatattcctgttttgtttcatagatctttgtattgagtctaatcgttgcatcattgatgacttttctagtaactgtatgatagaatattttttccagctgctgacgatcgatcctctttatcatatgggaatcattcataaatacatttacaggcgtctgcccattcaaagcggcatgtggtgaattgtttttctgattgacatatataccaaaagctttatcgatatcatcaattgttttgaattgggagaaatctgtattgtacatccactgttcttttaccgatttgaaagctcgctccacttttcctttttgattgccatgataaactttggcgtggcttatttggatttgcagctgagcacagatgataggcagttgttcatttttataaggagaaccattatcagtaaatatccttttcggtatgccaaatttaccaatagccctttttaaaacagtctgtacattaacggcattgtcttccagaaaaaatccatagccaacgatcattcttgagcgatcgtcaatgatcatgatcagataggtccttaacttacgaccgtttttattagtgatataagaacagtaggtcgtatccaattgccacatgtcgttggcatgttccatttcaaaggcacgcatatcttcgacaggaaggcgattcagttctggccttgaagcaatgaatctcgatactgttgaaagtgaaacatcctttttcagaatatcaccatcctctattagcttcagatagacagaggtcgctgtcattctcggattgtcggtttttagtttgattattttttctttgatgcactttgtaagcttgcgagaagttcctttatctccacgtattttaggcataagtccatcaaaaccatacttgcgatacagatcgtaccagtaacgaatggtttgaaaagagaattctttagatgttccatcaggatactgaaagggagtagaagaaattctcttataatactgcaaggcagaacggtcaggataggtttcgttgagaacgggaatgatctgttcatacctgaaaagagcgatctgcatatttaaatcttctttttttacattattcatatagaatatacctcctgacataaccatataacacctatatcaggtattcaaaggaaacgttatgggaaaaagcaatcatgaataaatgatcatatttttcgtcaggatacgttgcataaacatggtatgatactctgcaaaatagctgatgatgaaatcaaaactgaggagatcacatgaagaaaagacactcaaaaaagaatcgagacgttccttgtgatattttagataaaagatgataagctttctgacaagttctattgaaaaaccagtgagtttggaaataacagaaatagaatcattggtattgcgaaaagaagtgataatcctgataatattaggattagacaggatgcggtaagggacaatgatgctgggaagaagtgcatgagtacagttgcagctttgacatttgatacgtgtaatagttaattgaacagtatcatttacatcaacctgcaaataacgagtgtaggtcgcatggttgtgaaaatgtccaacagagccacaagtgcatctgatatgggaataatttatttttttaatatcttctttataagagttttgatcatatttattgataaaagttgtttgaaatgataacatatagattgtaaaacatacgttttattttagaaaaagaaaggcaggagggcgatccaatgaccctttctttttttgtatgtcagctcctttatataataataaaatagttaaaataatttgcctatcattttatcaaattattttaactatttttctatgtttattatttttgtttgactaaatagctgttattttaattaaaataattcaccgaataacaatcaagttgactaaggtcgatgaagattacccggacaacaagctgacaggagcgacctttgaggtttacaaagatgtaaacggcgacggtaaactggatgacgccgacgagcttatcggaactctctccgaaacctctaccggtatttacgagatgaaggaacttctttacggaaaataccttgtaagagaaaccaaagcaccggatggctttgagcttgataagggtgtgtactctgttttcattgaaaaagatgaaaccacctacgaggtagaaaacaaagccggcgtcggctttattaacacagctatgaaaggaaacctgaaaatcgttaaaacttcctctgacggtaaggttgaaggcttcactttcagagttacaggagtaaacggttacgaccgaagcttcacgaccgataagaacggcgaaatcattatcgagggacttcgtatcggcgattacaccatttccgaggttcaggatagtgtttctgcttcctatgtgcttcctgcggataagattgcaaccgtaaaggtcggttctactaccgttgtggaaatgcacaatgagctgagagatacaccaaagaccggagataacagcaatgtgggcttgtggacggcacttgcgggactttctgccctcggtattgtcggcacagccgttgttgcgtacagaaaaaagaagaaggaggacaatgagtaatggacgctaaaacaatcgtagcagttgtattagtcgcctttattatcggcggctttatcttcttgcagattaagaacagaaagaaataaggaacgcttgtgtgggcggagtgaaaacttcgcccaccgttcttttacggaggtgcattatgaataagcaaaagacggttgacagcaaggtgcttgcaatactcagagaatgccccgaaacgaggtatgacgatatgcagcttatcctttgctattacaaccgatacagctatatgagagtcggagatttaccgcttgaggatatagtcaacaactataaaggctacggcttgccgtgctttgagactatccgcagagcaagacagagagtgcaatccctatttcccgaactgtcaaggcagtgcagtggctgcgactgcggaaacatcagaattgtgattgaagtaagctgaggtgtggatatgaacgagggaaaaagaaaaatcggtgaatacactgttctttgctcggtcaatgtgggcgaaaaggaagttatcttggcttccaatgagcaaagtacaaacggcgataaatttatgtgcggctttgcagagcgaaacgacctgtttgaactgtgttcggaatgtatggtaagcgatgactatatcgaaatcgtacaccttttcggaagccgtgtggcaaatgaagcggagcttttcaaggaacaggtcgaaaaactggatattccaatcacactcataacagaagccgactgtatccccgaccactattccaaagacatcaacggcaaaatcatagccattgaccccaaggtattaaagcctgaatttcagagagccgacagacagctctactatgttacaggtggtttcggtgcgtcggcaaacagccgtggaagtgccgtgttttgtaccaatcttcacaccggcaaatcaacccgatatgaaagaatggatgttatgggcgaaataaagcctgagcgtctgcctgaatgggcaaaggaaaaggcacaagagctttcaaacaagaagcgaaataaagacaaagaacgataaggaggacaaagcaatgaaggaaaatttcacttttcagcaaaagacaaagcttctgacgaaactgtttgacgcaggctgcaataccgaaaagaaattgcagcagctcgacatggagagcattttgaaaattccgggtatcactattccggatatgagtctgattatcgagtttcagaagcagaccaaagccaataagctgttctcttatttgggaggtggcactgatgagcaggcaggaacagaatgaccgccatatcatttggagcgacattagccttgaccttgatgattggcgagagtctttggaggaactgtatcccggatattccgatgatgagctttacgacattatggtaaaatccaatgccgaaaatctttatgatgaacgagtaaatctcaatattcagctttcacagccgattattgttatcggcgacctcggcagatggaacggcagagtgtcgggctacaagatgattgattccggcaacattaaggactgcctttattccgataccgattacaacgaatggtatgtggataagtacggcgaccttcgtgccgacgccgttcatcacgacggtacaaaccattatctttaccgtgtattcaaagacggtgttaccgatacgcagattgaaaatctgcaagataaaatctataacggaaaagccacaagagccgacatcacacgagttaccaaaaggctcggcgatgacattgccggagtttatggttttcctattccaaagcaaagacaaacaaacgaacaagcgaggtgatgaaaatggattacagagtattgaccgaagcagagcgtaaatacaccttcagccaaagtcagcagctctctatgcagaccggtcttatcggatatttgagagccgacttcggttctaacgggaacgagttttggacgacttggaacgatttcagaaaagacttgaaaaccgatgaatttaaggctgaatttgatgaagtcataaacggattgcgtgacggcgatgttttgtccggcagaaaggctatgtcctcttactgttattccactcccgacagctcctttaatgatgactgcaaccactacggcatccgtcttgatacgggaaagtacagctatcttatgagatttaaccccaacaggggcgagtacaatctgtactgctattgctatcagaaagagtggctaaatgcccacttgaaaaacgctgagcgaggtatccgatttatcaacccgcactatcaggagcagtttcgcattgcggacggagaaaaaatctcaatcaagctcggcgacggcaaaacaatggagagaacttgcagatatatcgacgactaccatttggaggtcggcacaaatctctaccatatctgcgaatttgccgagctttgcgagagaaacggtcataccgtagaaccagccgcaaaagaaaacacgaaatccgcaaaggacaaagaaaaaacacgataaggaggtgcagacgaggtggcaagaaaatttgacctgatttcagagctgtatgaaagaacctgttttgcagttacagacaatccggtaaactggcaatcgtttctgaaaacagcaggcagaaatttcaggctccgatttgatgaacagcttctcatttatgcccaaagacccgacgcaacagccgtgcttgaaatcgaacgatggaacggtactttcggtcgctgggtaaaccgaggagcaaagggtattgccgtatttgaggacacagacagaagccgtcaaaggctgattcattactttgatatatcggacacccacgaaagtcgacattcccgccctgttccgatttgggagatgagacccgaatatgaagcagaagttattgaaacacttgaaaatactttcggtgcggtaaacgatacaacgagtattgaaaatgtcgtcaaagagagcattgccaatgccgttgaggataacatcgcagactatatctccgactttatgagtttgggtgcaggaagcgatattgagtatttgtctgccgacgaagcaaatgccttgtatttggagcttgtcagaaacagcgtatcatatatggttatggcacgattgggactgaacgcagacaaggtctattctcccgatgactttgccggtatttcaagttttaattcacaggaagttctcaatgcggtgggtattgctacaagcgacattgcagaaatggcgttgctccctgtcagcagaacaatcagcacgctcagcaaggaaaatcgcataattgatgaacaggagcaatccgaatacaataaagacatcaaagacgaaaggagtcaaagcgatgagcgaaatcacatacacgatggtgggagattacaatcttccgaacctgaaactgccggagcagacggaagtgactctcggcagatggtcgcagatgaggagaacttatctgaaggaacatcacaaaatcctgtactacaatcttctgacgaaagggattctgaacagtcacttggcggaggttcagcagagagccagcgaactggaggaaactctcgtgaagcagatggcacagaaagccgggctgacggagcagatgaaagcggaagatatgatgaagtgggttcgcctgatgaacaacatcaggaactcggcacaggaaatcgtgaagaatcaggtaatattcgcttagagtattacgacagaaaccacgaggacaagagcctgccgtttttcggtggcgatgatactatccgagagatactcggtactaccccgcatttgtccgcttcaaaggaagaaatcaaagacttctatgagagaaatacggacaatgcgacccgtaccgaatatatcaagggtatcttcaataacgactacacccggcttaccttaaacgacggcaggcttgtgggatacaaaacatttcagaatgtcctccacttgtgggagggtgaatacgaaaacagaaccgctcagagtttctacgactggggcgttatcgcacagcattttgaagcaatgagacttttgggagaattgaccgatacaatgaaaccgattccgtctatggacggtcagttgactctcattatgggaaatcaggcagaggaacaaaaaacctctgcctttactttttctcaggaaatcatagacgctgtattgacccgtggaagcggagtttccgagggtaaaatgcgtatctatgagcagtttgaaaagagcatttccgcaaaagagaacgccgacttcttgaaaaacgaatacggttggggcggctcttatccggtcatcatcggtgcaggcattgacgaacagcacgacggaaaaggtatcacaatttcaaaaggtatcggaagcgacaagccgcacattactctttcttggtctcaggtggaaaagcgtatcggagaccttatccgtatggacagatacctaaacccaaaggaaaaagaaaagtaccctgaatggcttgaaaagcaggaagaacggcgagccgagcttgcagagcagagaaaaaaccgtgagatactttctaccgcaccgcctgaacctgaaaacaaagaggacgagccggaagcgcagtatgaatatcatctcggcgacagcgtgtatattggggcttctcagtatgagattttgtcctttgatgaaaaccgtgtaatgctctatgacttcgatatgcccttattcaacaaggaactttcaagggaagaatttgaccgcaaagtgcgtgaaaatccgatgaacgaccacttgaaggtcagtgtattaccggcggaagaaaaaaccgttacaggcgaaaataaagctcaaaacgatactgaaaccgtaccggatttcagtccgaaaaccggttatgacgacgccttctttattgaccgggacaatgaaagtgtaacttggatgtactataaccccgacagcaatgccggaggtcagtatgttacaaatactctttcttttgacgagatacagcaagtcgcacgggagtatgactcggcagaggatttctttgattatctcggtagcattgcaaatcaggagcttgccgatgtaggtacggaatggtttgtggacgcagaccgagaatttcacaggacaccggatttgaccgactgtacctctgccacaatggaagctcttattgaaaacactgaaagagctgatatggtggcaacaaatatcgggaatgtaccgattgaggattacagagaaatcgttgctactcaaaacggttttgacagcgatgaggaaatgtataacgagggtgttcgtatcggcaacggttacgacaaagagcctgaaccgattgtccccgcttgggagcaaaagaaaaagtcaaaagtaaagagctttgacctccacccggatattcctatgtccgaacgacacaactttgaccttgccaataatcaggttgaagaagtgaacaagaaagaacgcttccaccgaaactatgcagcaataaaagtcctgagagattgtcaaaacgaaaaccgttttgcaacacctgacgagcagaaaatcttgtcgagatatgtcggttggggcggtattcccgaagccttcgacgaacgagcaggagcttggcatacagagtatgcaatgctgaaaaacatcctgacgccggaggaatatgcgtcggcaagagaaagcacactgactgcattttacactccgcccgaagtatctaccgccatttacaaggtgttggaacagatgggatttcaggagggcaacctgcttgagccgtcctgcggtatcggtaatttcatcggtatgctgcccaagtcaatggaaaacgcaaaggtttacggtgttgagcttgataccatttcagccggtatcgctcagcagctttatcagaaatcttccattgcggcacagggctttgaggaagtaaatgtccccgacagcttctttgacggcattatcggcaatgtgcctttcggagatttcaaagtctccgataaacgatacgacaagtacaatttcttaatccacgattatttctttgcaaaatcgcttgataagttacgccccggcggtgtgatggctcttgtgacaagcaaaggaactatggacaaggaaaactccaatgtgcgtaaatatatcgcacagagggcggagcttctcggagcaatcagacttccgaacgacaccttcaaaggtaatgccgggacagaggtcgtatccgatattctgtttctgcaaaagcgagacagactcatagatattgagccggattgggttcatcttgacaccgacgaaaacggtataaggatgaactcatattttgttcagcacccggaaatgatactcggcgaaatgaaaatggtaagcggtcgcttcggaccggaagcaacctgtgaaccgtttgaaaatgccgacctttcggagcttttgaacgaagcagtctcaaacattcacggagaaatctccgaatacgaggttgccgacgaactggaggaagaagataattctatcccggcagaccctatggtaaggaacttctcttacactgttttagacgataaaatctatttccgtgagaactcccgtatgtccccggtggaggtatctgcaaccgctgagaaccgcattaagggtatgattgggataagagattgcgtccgtaacttgattgaactgcaaaccgaggattacccggacagcgaaatcaaacaggcacaggataagctgaacacactgtatgacagctttacaaagaagtacggactgattaacagccgtgccaatacttctgccttttccgacgacagctcctatgctctgctctccgctcttgaggttatcaatgaagatggcgaactggaacgcaaggcggatatgttcttcaaaaggacgattaaaccgcacaagccggtaacggaggttgacaccgcagacgaggctctcgctgtctctatgggcgaaaaagcagccattgatatggaatatatgatggagttgtccggcaaaagtgaggaggaattattcgctgacttaaagggtgtaatcttcttaaatcccctttatgagtacggtaattcctatgagccgaagtatctgatggcagacgaatatctgtcgggcaatgttcgtgagaagctggcgacagccaaaaggtctgcggcactgtatcccgaagattacaccgtcaatgtgcaggcacttgaaaaggtgcagccaaaggatttgacggcaagcgagatttccgtaaggctcggtgcgacttggataccgcccgaaatattccaacagtttatgtttgagtttctcgacaccccacgctatgcacaatggaatatcaaggttcactactctcagtttaccggcgaatggaacattgagggaaagagctacgaccgttccaatgtaaaagcgtacagcacatacggtacttcccgcatcaacgcatataagataattgaggaaacactgaacctgaaagatgtccgaatctttgactatatcgaagatgaggaaggcagaaagaaagccgttctcaataaaaaagagacggcaatcgcacaggcaaagcaggaactcataaagcagggctttcaggactggatatgggctgaccctgcccgccgagaaaaactcacgaagatgtataacgaaaagttcaacagtataagaccccgtgagtacgacggaagccacattgttttcaacggtatgaacccggaaatcgaactccgtgaacatcagaaaaatgcggttgcacacattctgtacggcggtaatacgctgttagcacacgcagtcggtgcgggcaagacctttgaaatggtagccgccgctatggagtccaaacgactgggactttgcaataagtcgctgttcgtagtgccaaatcacttaaccgagcaatgggcggcggagttcttacaactctatccggcggcgaatattctcgtagcgacaaagcgagattttgagacaaagaaccgcaaaaagttctgcggtcgaattgccacgggagattatgacgccgtaatcatcggtcattctcagtttgagaaaatcccgatgtccattgaaagacagagggcaattcttgagcagcagcttgaagaactgacagacggtattatggatttgaagcgaaaccgtggagaaaacttctccattaaacagcttgaaaagtctaaaaagtccgtgaaacaaaagctggaaaagctcaacgaccaaagccgaaaggacgatgttgttacctttgaagaactcggtgtggacaggctttttattgacgagagtcattattacaagaacctctatctttacaccaaaatgcgtaatgtgggcggtatcgctcaaacggaagcacagaaatcctccgacctgtttatgaagtgccgataccttgacgagcttacaggcggtcgaggaacggtatttgcaaccggtactcctatctcaaacagtatggtggagctatataccattcagcgatacttgcagtacaacacgcttgtcaaaaacaacttgcagcacttcgactcgtgggcaagtacctttggagagactgtaacagccgttgagcttaccccggagggaacgggttacagagcgaaaacccgctttgcgaaattctacaacctaccggagcttatggcgatgtttaaggaggtcgccgacatcaagacggcggatatgctggaactgcctgtgccggaagcacacttccacaatgttgcggtcaagccttcggaaatgcagaaagagatggttgcttcccttgcggaacgagccgagaaagtccgtggcggcggtgtagattcgagtgtagataatatgcttaaaattacaaacgacggcaggaagttagcacttgaccagcgtatgcttaacgatatgctgcctgattttgagggcagtaaaatcaacgcctgcgtcgataacatctaccgtatttgggaggaaacagccgataaaaaatcggcacagcttgtgttctgcgacctctcaactccaaagaatgacggaacattctcggtatataacgacatcagaaagaagctcatagagcgtggtgtccccgaaagcgaagtccgctttattgttatttagcactttatattaactagaatttatcaaattattttaactggctttttccattattttgactaattagttatgacaatcacactattttacttattcccgtcaaattacgccaactataatttcaatataaaaagatagtaattttgccttttaacagctaattactatcctcttttaatattaaactttatactgtattctctgatgaaaattcaacgttatgcctggtattgtgctatatgagcgcttattatacttaatccttttgctatcgtcaatccatcaataatactgttcatataacaggctattttttcactgttccagaaaatatcatccaaactgctaagttcactggatactccaatacctggaatatccagccatctcttcatatcaaagttaattacatatacacgatacctgcttccccttgcgcttactgtaaatccagtaattctatcatcgatacttatatcttttaacacacattgccatgaagtgttcttataattacatatataagttatttttttatccaatctcatttgctgcctccattacaatttcattatcaatagtcattttttctctggcagctcctattattaaacaatgagtcagaagattattgagtttgcgtgatgatccctggcaggcattgctcagtgctttaactgcctctggtaatatcaatggctgtgttcttcctgctttctttagtttttcaatgatgtatctgcctatatcatcttcattcattcctgacatttcatactgaataacgattctctgtttcagtgcttcgtgtacagctcggttgattgtatgattaagcactggagttcctgtcatgatcaaaatgacataattacttgaatcaaaattaaagttaagaagcatgatcagatcattgagaatagctgtctttaaatattgtgcttcatccaggatgatgacaggtatgatccttttttcatcaactgtacttttaatatagttttgtatatttctgaagttgtctatttttttatgcattggttcaagtcccaactgactgcacagttcacgatagaattcaatcgtcgtaagtgttgacataggcatataaacaactttataaagtccaggattcagcgattcactaaaacttttcataataaatgtcttccctgtaccacttcttccagtaaaaagtccaatgcccctgatatctttgagatagttgagtcttcctattgcttctttaaagtcatctgtatctatttctatatctggctgtcccttttcaaagggattgaattccatcccatagtatatcttgaaatctttcatagctgttcctcctgtgcaaataaaggcctttttcgttttattcttgaattatcaacctttctgacctcatatatttcgatatagctgtcattttcatatatgaaaacatgacttagatcagggacatatttaattgtgactcttgttccaatatattcctgttttgtttcatagatctttgtattgagtctaatcgttgcatcattgatgacttttctagtaactgtatgatagaatattttttccagctgctgacgatcgatcctctttatcatatgggaatcattcataaatacatttacaggcgtctgcccattcaaagcggcatgtggtgaattgtttttctgattgacatatataccaaaagctttatcgatatcatcaattgttttgaattgggagaaatctgtattgtacatccactgttcttttaccgatttgaaagctcgctccacttttcctttttgattgccatgataaactttggcgtggcttatttggatttgcagctgagcacagatgataggcagttgttcatttttataaggagaaccattatcagtaaatatccttttcggtatgccaaatttaccaatagccctttttaaaacagtctgtacattaacggcattgtcttccagaaaaaatccatagccaacgatcattcttgagcgatcgtcaatgatcatgatcagataggtccttaacttacgaccgtttttattagtgatataagaacagtaggtcgtatccaattgccacatgtcgttggcatgttccatttcaaaggcacgcatatcttcgacaggaaggcgattcagttctggccttgaagcaatgaatctcgatactgttgaaagtgaaacatcctttttcagaatatcaccatcctctattagcttcagatagacagaggtcgctgtcattctcggattgtcggtttttagtttgattattttttctttgatgcactttgtaagcttgcgagaagttcctttatctccacgtattttaggcataagtccatcaaaaccatacttgcgatacagatcgtaccagtaacgaatggtttgaaaagagaattctttagatgttccatcaggatactgaaagggagtagaagaaattctcttataatactgcaaggcagaacggtcaggataggtttcgttgagaacgggaatgatctgttcatacctgaaaagagcgatctgcatatttaaatcttctttttttacattattcatatagaatatacctcctgacataaccatataacacctatatcaggtattcaaaggaaacgttatgggaaaaagcaatcatgaataaatgatcatatttttcgtcaggatacgttgcataaacatggtatgatactctgcaaaatagctgatgatgaaatcaaaactgaggagatcacatgaagaaaagacactcaaaaaagaatcgagacgttccttgtgatattttagataaaagatgataagctttctgacaagttctattgaaaaaccagtgagtttggaaataacagaaatagaatcattggtattgcgaaaagaagtgataatcctgataatattaggattagacaggatgcggtaagggacaatgatgctgggaagaagtgcatgagtacagttgcagctttgacatttgatacgtgtaatagttaattgaacagtatcatttacatcaacctgcaaataacgagtgtaggtcgcatggttgtgaaaatgtccaacagagccacaagtgcatctgatatgggaataatttatttttttaatatcttctttataagagttttgatcatatttattgataaaagttgtttgaaatgataacatatagattgtaaaacatacgttttattttagaaaaataaaggcaggagggcgatccaatgaccctttctttttttgtatgtcagctcctttatataataataaaatagttaaaataatttgcctatcattttatcaaattattttaactatttttctatgtttattatttttgtttgactaaatagctgttattttaattaaaataattcaccgaataacactttatccacgaagcagataccgatgtgaagaaaaaagaactgttccaaaagacccgtaaaggcgaggtcagagtgcttctcggctctacgcaaaagatgggagccggcacgaatgttcaggacagacttatcgcacttcacgatgtggattgcccgtggagaccgtcagacttggagcagcgttccggtcgaattatccgtcagggtaactcaaatcctgatgtagatatttaccgctatgtaacggagcagacctttgacgcatatctctatcagcttgtagagggaaagcaaaagttcgccagtcagattatgacgagcaaatccccggtgcgttctgccgaggatattgatgaaaccgccctttcctatgcagagattaaaatgcttgccaccggcaacccgtatattaaggagaagatggatttggacattcaagttcaaaagctgaagctcttaaaatccaactttctatctgaaaaatacgctttggaagataagataatcaaatattatccgcagcgaattacagctttggaaaaccgtattgaaggattgaagcaagatgtagaaactgcgaaacagcacccgaaaccaacggacgaccgatttgtcggtatggaggttaagggtgttttttattccgaaaaagccgacgccggtaaagcaatcattgaagcctgcaagcagatgaacagccccgaccctattcctctcggcaagtaccgagggtttgaaacggaactgctttttaataccgcagagcgaaattatgaggttcgactgaaaggtgcgacaagcagaaatgttcctctcggtgatgacgcacacggcaatattatccgtcttgataacggcattgagagatttgccgagagcttgtcgcttgcggaaaatgaccttgagaacaccacaaatcagttggaaaccgcaaagaaagaagtccaaaaaccgtttatccaagaggaagaactaaagacaaagcttgcccgcttggacgagctgaatatcttgctcaatatggataagcgagaaaacgaaattgtcggcggcgaacccgatgagggcgaagtgccgaacacacgaaaggagaaaacctatgaacgataaaatgacacccgataaggaaagagaaaactgcccttgcagaaaagcaatcattaacccttttgacgcaatgatgatggttgtggtcaggagacttgataaagcatatctcgaattgaaaagaagcaaaccgcccgcaaaggaagcagaatttgcccttagaaatgcaaagctttctttctacggagagttggttcgacagagcattgaaacggtgttttcgccggaagaaatcattgctttgtatgaaaacgacgaccttgcgggaggtgcttggactgtttggaatgacatcggctgccctgttgataagatactcattatcattgcaaagctcagtatcaacgaaccgatacagaaagcggttgccgatttgctgatgtagaacggcggtgataattatgccgtatattgcaccggaagtcataaccgaagccaaacgaatggatttattaacctatcttagagagtatgaaccgggcgagcttgttaaattttcaagtaacacctacaccacaagaacccacgacagcttgaagatttccaacggcaaatggatgtggtggtcgagaggtatcgggggcaaatctgccctcgattaccttatcaaagtccgtggaatggattttgtggaggcggttcagaccattatgggaaacggttcagtcagctttccgacttgtgaaaacatcaaaagttatgagaaccagcctttgcttctgcctgaaaaaagccccactaccgatgtggtatttgattatcttttcgggcgtgggattgattatgaaattatcaactactgcttggaacagaagctaatcatcgagtcgctcccatatcataatgctgtttttatcggctatgacgagaacaaagaacctaaatacgccgcatacagagcaacaaatcaatcaagaattatgggcgactgcaccggaagcaaaaagcaatattctttccgcctgactgccgagaacaccggagaggttcatctttttgagtgtgccattgacctgctttcctatgcaactttgatgaagctggagggcaaagactggcgacagtttaaccttgtttctcttgcgggagtgtattccccaaagcagaaaatcgaggactcgaaagtgcctgttacactcggcaggctgcttgaaaaggacaaaacaatcaggcgaattgttcttcatttggacaatgatattgccggaagaaaagcgaccaaagcgttgcagacgattctttcagataagtatgaagtcgttgacgaccctccccaatatgggaaagatgtcaacgactttctttgtaaacgcttgggaataaaagataaaaccgaaaggagttttgcacgatgaaactaaaagaaatcagagaaatgtacccggagggaacgcagattgtactcactgaaatggctggcgaaagtcaaatgccctacggtctgaaaggaacggttaaattcgttgacgacgccggacagattcatatgagttgggaaaacggaagctccctcgccttgaatattaacgaggatacctttgaaaaggtagaagcacctgagaagatttccgtcattcttgttgagccgggcaggtatccgaagctcattgaaatcgaggatacgcttgaagcaatgcagtctcttgtggagggagatattgaagaatatatgccctttgaggaagaagttgccatcatctgcaacgatgaaggaaagatgaacggcttgccgttgaacagggcagtttattccgagcctgagaatgttgagatgagttatccgcagttgaaagctcatttccggcaggcagaaaaagaaagaaaccacacgaccggatatattgtttttacggatgacagctttgacaagccttacacagaggaacaaagaacctatgttgtcagcagtaacaataaggctttcattgagggtatgggaggatattctatctatgcttcttcccttgacggctcggataaatgtgtgcgactggaagcgtatatggctgatgaacacggcggcaaggatggttggaagattgaaaaatgttatgtgaaagacgacagcaaccgtgaaatgctcgacattattgccggcaagttcttcattgcatacgcaccgattgagtcggaaaagttcctcagtatgccgaaagaactggctcgtaagtacgaggaaaagttcaaatacccggagagattttataagtccttggacggtattgaagcaaagccgtataagcctgtctcaaaggatatggagagataagagtcaatctatggggcaaccctgagtgtctgcataatcttagcgagcagaccatttatggacaggaatgtccaaaacggtacactcgttaggggttgcccctaataccccaagcaagaaaggagcataagctttgcgggagatagtattggtcgccgccgggttactcatcggcggctttttcggagtaacaacaatgtgcctgtttcagataaaccgggacagacactatatttacagaaaggacagcgataaaaatgagcaagagaaacattgaaaagcacattctgatgaacaaggcagaagctcaggatttgcagaaaaaagcaaagcgggcgtgtctttccgaaggcggacttatccgtttgcttctcagaggatacgagccgagagaaaagcccgatgaaagattttacgatgttatgcgtgagctttccgctatcggcaacaacatcaatcagcttgcggcgaaagcaaacaccctcggatttgtggacgcaccgcagctcaaaaaggaagccgagcgttggcacaagtttcaggctgatgtggagcgtacttttttaagacccgataagagcgatatgaaatggcagtaagtaaattgtggtcggtcacatcaaggctcggtcaggtaatcgactatgccgccaatcccgaaaagacggcggcagacatttacaccgaggaacagtatcaggctctccgtgatgttctcagctatgcaaaggacgaagaaaaaaccgagcgtgagtttttcgtagagggtatcaactgcaaccctgcgaccgcaagagaccagtttatatctgtaaaaaaagcatacggcaaagacgacggcattcaagcctatcacggatacctgagctttaaggaacaggacatatccccggagcttgcacagaaaatcggaatggaatttgcaaacgaagtgtggggcaaaagatttcaggtggtggttactactcatctgaacacgaaacacctgcactgtcattatgtaataaactccgtttcctttgtggacggcaagcggttatggggcgacgaaaaagcgtggttcaagtttcgtttggttgccgactgcctttgtgaaaagtacggactgtattacaatccgaacccaaaccgcagtaagcaatcctcttattactacaagcaggaacaagccggtatgccgagccgatattcaatgacccgtgacgccattgatgaagcgattgcacacagcaccaacttaaagacctttgattatatcctgactcagatgggctatgaacattgtctcagcgacagtcgaaagtattggacgattgtcccgaaaggatacaagaagccgatacgacttaaatcactcggagagaattataccgaggacgcaatcaagcgtaggctgacggaaaatcaaaaggttcttatcgttccttttgcaaaggaaacggtaagagtcaggcagtaccgaatgcccacaagagaacacaaagtcaaaaaggtcggcggactgtatgggctgtatctgcattactgctataagctgggttatctgccgaagtacaaaaaacagaataccgcaaggcttcactatcttttgaaagaagatttgctgaagctcgacaaaatcactcaggagacaaggctgcttggacgggagaacatttctaccgacgagcagcttttctcatataaagagtccgtgttgtcgcaaatcaaatccttgactgacgatagaacgcacctgcgaaaacagttaagaagaaatttgagtgacgatgagctatcaaatgtcaaagagcagattacggcaatcacgagcaagctgtggactctccgcaaagaggtcggtctttgtgatgacatagccgaaaggtcaaaggttattgaagccaaccttgaaacggtaagagtttacgaagaaaaacaagaacgaaaggagcagaaccgtaatgacaaacggaggtgatgcggcagaacaggtcgtcaggctatcgcttgaaggctttgaagtagccgcaaaattaagcggagcggcagcaaagaatattgccgttcttttagtctctgttctcaaacaggaacagaaaacaaaaggcaaggctcgacttactaatatgattaagtcgggcaaggagctgaaggtgttttctatccccaacaaggacttgaagaagtttaccgagcaggcaaaacgctacggcgttctctactgcgtactcagggataaaaacacaaagggcgataatgtcccgattgatattattgcccgtgcagaggacgcttccaaaattcagagaatcgttgagagatttgaactcggtaaagttgataaggctgcgattgtcaccgagtctcagaatgttattcggtggattattttaattaaaataacagctatttagtcaaacaaaaataataaacatagaaaaatagttaaaataatttgataaaatgataggcaaattattttaactattttattattatataaaggagctgacatacaaaaaaagaaagggtcattggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcgctgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaatagtgaaaaaatagcctgttatatgaacagtattattgatggattgacgatagcaaaaggattaagtataataagcgctcatatagcacaataccaggcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacactcagaaggctgtcgaaaagcgtgaagctttggagaaagacaagccgacgaaaaccaaaaacgaaatcatcactgaggaagccgtcagaaaacctattcagaaagaggggtattcccagtcaaaccccacagtcgccaaaacggacaaaaaccctccgtcaaggcacgactccgagccggtagatatgcaaactgataagggtactgtaagcgacagacagagaaagccgtcggtaaaagcaaagcttgaccgatataaggcacagtccaagcagcagaaagaagcagaacgcaaagagccggaggtatcaaagccggaagtcaagaacgccccggcacagaccgtacaccagcagccgaaacctaaaagcaaaaatgtgaaagagaggtaatcacaatgacaaacaattttacccctgctaaggcaggacagcagagcaaacgactttccaaagaggaatatgccgagaagatgaaggctgaaaaagaagccgtatatcagatggcggacgacaccgcaaaggcgattgtttccgacccggaaaagttcaaagccttccttgatacgcagagccgtcttgacagatactctgcggtcaacgcacttctgattttcaagcagcttcccgaagcaagccagcttaaaaactttgatgactggagcaaagataatgtgaaaattcagaaaggtgcgaaaagcatttccattcttgaacctgtcgagtatgcaaagaaagacggtacgaccggcatttcctacaatgtgaaaaaggtctttgatgtttcgcagaccaacggcaaaagaccgcctgcaccgactgtcaaccgtgacccgaaagcactcattaccgttatgctggattcttccccggttgaagtggaagcaacaaatgagcttccgtatcccaatatggcggcgttttataacaacgaggaacagaccttgtatgtaaagcgtgatgtgggagacagcgtagcggtcgctcagtgcgtagcacaggagcttggccacgcacagctctctatcaacagcgacagttacagcagagcggatatgggctttcaggcagtatgtatcggctatatgctttgcaaaaagtacggcgtcgatacacagaattttgctatcaaccgtatccctgaaaagctcgccggcaaagagccgaaggacattcgctatgagctttccaaaacgagaaacgcaatggcggatattcactcccgtgtttccgatgagctttacaagaaaaagcaggaacgaagcaaagactacgaaagataaggtgagactatggcgaaggaagaaatgtatcatatcgcattggacgattatgaacacggcattattatccgttctctcaacgacgagaaaacagatttgatgaacgagggcaaatctaccgatgcggtggacgaccttatcatcaaggtcggaactgccccaaagaaaaagttcaaagttatcgaaaaggaacgctcctgtgaatcgagataacgagaggcagtctgctattattctttccgtcatcggtattatcccggtcgtatggctggcacttctgattgcaccctctgtaaaaggaggattgccggaaatactgccgagcctattaacagcgttcaacgaaccatttcatattgagctatgcgaggacagcctaaaaactgtcctcgttttgcttctctgctatgcaatgggtattgggatttacttctcaacacagaagaattaccgaaggcgtgaagaacacggttctgcaaaatggggcaatgcaagagccgtaaacaaaaaatacagacagtctccggcttctgcaaataagctgatgacgcaaaatgtctgtatcggactcaatgcgaagaaacaccgaagaaacttaaacacccttgtgtgcggcggttcgggagccggtaagacaaggttttactgcaagccgaatcttatgcagtgcaacacatcatttgtcattcttgacccaaagggcgaaattctccgagataccggaaagctgcttgaaagcaaaggctatgaagtccgtgttctcgatttgatttcaatggagaaaagccattgctataacccgtttgtctatttgcagaatgacaacgatgtgcaaaagctcgtgacgaacctttttaagagtaccactccgaaaggaagtcaatcacaagaccccttttgggatacctcggcttcaatgcttttgcttgcacttgtattttatcttcattatgaagcacccgaagatgaacagaactttgcaatgataatggaaatgctcagagccggtgcgattgaggacgaggaggacacaagaccttctcctcttgatgaactgtttgcggaattggagatgtcgaatcccgaccacattgctttgaagtattaccgttcctatcattcaggtgcggcgaaaaccttaaagtccatacagataacccttgcggcaagactggaaaagttcaaccttgaaagtcttgcttctttaaccaccacagacgagcttgacctcccgtcactcggagagaaaaaggtcgctctgttcgctttgataccggataacgattccagctttaacttcttggtatctatcctttacacacagctttttcagcagttgttttatgctgccgaccatattcacggcggctcgcttcccgttcccgttcattttttgatggacgagtttgcgaatgtttcactccctgatgacttcgacaaaattctttcggttatgcgttcccgtggggtatcggtaagtattatcttgcagaacttggcacagcttaaagccttgtttgaaaagcaatgggaaagcattgtaggtaactgcgacgagtttttatatctcggcggcaacgagcaaagcacccacaaatatgtgtccgagcttctcggcaaggaaaccattgataccaacactttcggaaaaagtaccggtcgaagcggcaactactccacaaattatcagattagcggtcgagagcttcttactcctgatgaggttcgtatgcttgataaccaatatgcaattctgtttattcgtggagaacgccccgttatggacttcaagtacgacatcttgaagcacccgaatgtggcacttacaaccgatggaaaggcttctgcatataaacacggcgaagtgaccatcaagcactcatcaatttccgttctttctattgacccggaagaacttccggaggaaagctacggagaaaccaattacgaacttctgtccgatgaggattttgaagtgaataaaaacttattttaacggaggaaaacacaatgaacatttttaagaagaacaacgaaaagaaaactactcagaagctgcctatgaccggaaaggttcagaaaggcttccgtgcttactgcgccgtaatcgcagcagcaactcttgtttgcggtatgagcgttaccgcttttgccgccagcgacccgattaccgtagtcaacaatctgtccgatttcatcttcggtcttatccgtgccatcggtcttatcctgcttggcttcggtatcgttcaggtcggtctctctttgaagtctcacgacccgtctcagagagccaacggtttcctgactcttgcaggcggtatcatcattacctttgcaaaggaaatccttacccttattaccggttaagagaacacagttatcaaacggggcatacctggcatttcaggtatgcccctaatcttaaaggaggtgcaaacagatgagtgataactgggtagttcagaacctcgaaaatgcccttgaaacttggaacagcaagctttcggaaatatggcagttgctaaccacttcgccgcaacagttcaaaggcggcagtatttggtcggtaatggtgaatatcaacggagcagttcaggctatcggtcttgccctgcttgttctgttttttgttgtcggtgtggttcgcacctgcggaagttttaccgatgtaaagaaaccggaacacgcattaaagctgtttatccgctttgccattgccaaaggtgtgattacctacgggctggagcttatgcttgccctgttcgacatcgtacaaggtacgatttcaaccattatgacatctgcgggattcggtacgcccaatcaaacaactttacctgctgaaatggtaacaaccattgaaagctgcggattttttgaaagtatcccattgtgggcggttactcttatcggcggactgtttatcacggtcttgtcgttcattatgataatgacggtgtacggacgatttttcaagctgtatatgtacactgctctcgctccgataccgctttccacatttgccggagaaccgtcgcagaatgtgggtaagagctttataaagagctactgtgccgttttgcttgagggagcagtaattgtacttgcttgtatcatcttctccctatttgcttctacgccgccggtagtgaaccctgacgcagcagccgttactcaggtatgggcatatatcggcgaactggtattcaatatgcttgtgcttgtcggtgcggttaagatgagcgaccgaattatccgtgaaatgatgggcttataacgggaggttctctgatgaagaaaaacaagaataataacgatagatggcagggctatacgcctgccgactgcgactgcaaatattgtgtgtattacggaggaaagaaaaacggcaatgtgatttgccttgcggacacctgcgtctgctctgatgaaatccgtcacgcaaaacaagcatatcgcagagaaaggagcttttgatggaagtcaaaattaaccgagagatacgaaattacacagagtcaatgttttttggactgtcgctcagacagttcattttttctgtcctcgcctgtgcggtagcggtaggactttacttcctcctaaaaccgtacctcggaacagaaactgtatcgtgggtgtgcattttgggagctgccccttttgcggctctcggctttgtgaaatacaacggaatgacggctgagaaatttatatgggcgtggataaagtccgagttccttatgccgaaaaagctggtctttcattccaccaacacctattacgaattgatgaaaccgacaatcgaacaaaaacagaaggaggcttataagaacaatgattaaaactcttacaaacctgttaaagcaggacaaagaaaagttcgtagtaccaaagggcgtacaggattgtattcccattaccgctatttatgatgacggcattttccgtgtaggcaaggacaagtattccaaaagcttcaagttcacggatattaactatgccgtagcgagccgtgaggataaggaagcaatgttccttgaatactccgagcttctcaactctcttgacagcggagctactacaaagctgactatcaacaacagacggcttaaccgtcttgactttgagaaaaccattcttatccccgaaaccggcgatgagcttgatgtttaccgagaggaatataacaaaatgcttctcgacaaggcaaccggggcaaatgccatcgttcaggataaatatgttactatctccatcaataaaaagagcgtggaggacgcacgaacctattttgcccgtgtcggtgctgacctgattgcccactttgcaagactcggaagcaaatgtgtggagcttgaaaccgatgagagactgagaattgtccacgatttcttccgtgtcggggaggaaaccgcctaccacttcaatattaaggaaacgagaaagaagggacacgatttcaaggattatgtttgccccgatacaatggaatttgaaaaggactacttcaaaatgggaaaccgttacgggagagtcctttttcttcgtgagtacgcttcctatatcaaggacagtatggtagccgagcttaccgacctgaaccgcaacctgatgatgtccattgacatcgtacctgttcctaccgatgaagcggtgcgagaagcagagagcagactgcttggggttgagacgaatataaccaactggcagagaaagcagaatcagaacaataacttttccgctaccgttccgtatgatatggaacagcagaaaaaggaaatgaaggagttccttgatgaccttaccactcgtgatcagcgaatgatgttcgctgtactcactatggttcatactgcggactccaaagaacagcttgataacgacaccgaagctctgcttactacggcaagaaagcatttgtgccagtttgccgttctcaagtatcagcagatggacggactgaatacggctatgccctttggaacacgcaagattgacgcattcagaacccttaccacagaaagccttgcggtctttattcccttcagggttcaggacatttaccacgaaaacggcatttactacggtcagaatgtcatcagtaaaaatatgattattgccgaccgcagacagctactcaacggcaactcttttattctcggcgtatccggcggcggaaaatcctttgcggcaaagggtgaaattgaaaatatcattctttcctccaatgcagatgttattatcatagaccctgagcgagagtattcgcagcttgtaaaagctctcggcggcgaaataatcaatatttccgctacttctccgagccatatcaatgcgatggatatgaacaaggaatacggcgacggagcaaacccggttatcctgaaatccgagttcattatgtccctttgcgaacagcttatcggcggtacaaacctcggagcaaagcagaaatctatcatcgaccgttgtacggcaagtgtttaccgagactatcagcagagaggatataccggtactgttcctaccttgcaggattttcgtgcggagcttttgaaacaggacgagccggaagcaaaggaaatcgcccttgctatcgagctgtttactcacggttctttgaatacctttgcaaagccaaccaatgttgatacggataaccgacttatctgttatgacattcttgacctcggcaagcagcttatgcctatcggtatgcttgtcgtcctcgactctattctgaaccgtattacacagaaccgtgctaaaggtaagcagacctttatcttcattgatgaaatctacctcctgttccagcacgagtattctgcaaacttcctgtttacgctttggaagcgtgtaagaaagtacggcgcttatgccaccggcattacacagaatgtggacgaccttttgcagagccatacagcgagaactatgcttgcaaacagcgagtttttgattatgctcaatcaggcgtcaaccgacagaattgagcttgcaaagctccttaacatttctgacctccagctttcgtatatcacgaatgttgacgcaggacacggattgattaaggtcggcagttcgcttgtgccgtttgcaaataagttcccgaagaatacgaagctgtataagctgatgacaaccaaaccgggcgagggtgcataacccttgccctattctgtaaatgagaaaggaaacacctatgaaaaacaaaatctatattgccataatctgtgctttcagcattgtatttgccgtcagttcaggttttctcatcaagcactattgcgactctgcaaagcaggctgagatgtacgacaatctgattgaggttgtggagaccgagcctgaagaaaccacagagctgatgaactactccgaagaaaagacctttatcccggagtgttattcggtgaattattttaattaaaataacagctatttagtcaaacaaaaataataaacatagaaaaatagttaaaataatttgataaaatgataggcaaattattttaactattttattattatataaaggagctgacatacaaaaaaagaaagggtcattggatcgccctcctgcctttatttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcgctgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaacagtgaaaaaatagcctgttatatgaacagtattattgatggattgacgatagcaaaaggattaagtataataagcgctcatatagcacaataccaggcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacacccggagtatcaggagctttatctgcaaaataacgatatggtcggctggattaaggttgaggacacaaaaatcaattatcccgttatgcagtcaaaggacaacccgaacttctatctgaagcacggctttgataaggcatacaccgactacggctgtccttatgttcaggaaaactgcgatatggaactgccaagcgacaatatcattatctacggtcatcatatgaacgacggctctatgttcgccggtcttatgaaattcaaggacaagagcttttgggaaaagcacaaaacagtatcctttgatacgctgaccgatagacagacctatgaagtaattgccgtgttcaaaaccgtagtatatacggatagtcccgacagcttcaaatattatcagttcgtcaatgcggacaccgccgaggatttcactgcctatgttgagaagtgcaagaaactgtcgctttacgaaaccggcataaccgccgaatacggcgacaagctcctgaccctttccacctgtgagtattcccggacaaacggcagacttgttgtagtggcgaagctaataaacgaataatacaacaggtagttcagcctgcataggaaggagggattgtatggctgatattaaaacgaaagacaatgcaaaaggtacgatacgaacaatagataaggctgccgtcgcaacccaacgaatgaagcaggcgtatatcgcaacaaaagaaaaggcggagcggtcggtaaatgccaacagcagttctgccgaggaatacgcttccgataaactggaaagcggtattgacgaggtgtttcacgatggtgcctatgcgtttgacaaggcgggacgaaagggacttgaaaccacaaaagagaatatccgcaccgcaaaggacggtattcagcgtttcaagcagcagcgagccgagcagtctttgagaaaacaggcttcgcaaaacacaagctctgcgattaagactgtcgataaggcggaaaagaccataaagcagtctgccacttcctccggaaagaaaaccattaagtttgccggaaaagaagcaacaaagaccgcacagaaatcggttaagacggctgagcagactgcaaagactgcgataaaaaccagtcagcaagcggcaaaagcggcacagaaaacagctcaggcgacagttaaggcttcgcagaaagcggcacaggcggcaaaagccacagccaaagcaacagccgctacgattaaagccgcagccaaagccaccattgccgcagtaaaagcaatcatagcggcggtaaaaggtcttattgccgctatcgctgccggcggttgggttgcggtggtagtaattattgtgctatgtcttgtagccttgattgcaggttctgtgttcggtatcttcttttcgggagaggattccggcacgggaatgtcaatgcagacagtcgttcaggaaatcaatcaggaatatgatgaccgattggaacaggaaaagaactctgtaagctatgatgtgcttgaaatgagcggaagcagagctgtttggaaagatgttcttgcggtctattctgttaaagtgaataccgaccccgacaatccgatggaggttgctacggttgatgaaaccaagaagcagctactgtcggatattttttgggaaatgaacgatatttcttcccgaacggaaacgaaaacccataccgaaatcgaagaaagcgacgacggacacggcaacatcgtacagaccgaaaccacagtaacagaaactttcctgtatatcacggtatcgcacaagaccgttgatgaaatggcggctatgtacggatttaatcaggagcagaaagagtatcttgccgagctgctaaaggacgaaaacaatcaactatggtctcaggtgctttacggtatcggatacagcgacgaccaaatcgtaacggttgccttgtcacaggtgggtaatgtaggcggtcagccttactggtcttggtacggatttgactcccgtgtagaatggtgtgcctgcttcgtctcttggtgtgctaacgagtgcggatatatcgacgccggtattattccaaagtatgccggctgtgtaaacggtgtacaatggttcagagaccgaggacagtgggcagacggttcgtatgagccttcgcccggtacaatcattttctttgactgggagggcgacggtgtgacagaccacaccggtattgttcagaaatgcgaaaacggtacagtctataccgttgagggcaactcaggcgacacttgcagaaccaaaacataccctgtcggaagctctgttatctacggatacggtattccggcatattaaaaagatggctgctcgtttgagtagccatcaagtacattatgagaaatcaggtatttactcaagaacaaatataaccttctgaagcctttgtcccaacaagagaaatatgcggatatataccattgacaacatcttcatagaatttacgaccgattcttgcagatgtaactctatttgtgaaaaagtctctaaagtggtatgtgccgggtaataatgaaggaacaacagcaacaataaaagcgttatattcattttgttccattttgttaagttttatcatcagtgttcacctccttgttgataagcctgaatttgtaaatggaattctgagttgttactaatagattgttctttttaatataataatcatcacgggaactaataattcccaaagaagtaattggtttaaaatcatcgtcaacaggatgccaaacaaagaattgtctgtttccattcttaagaatatagataacaccgtcttgacctatatatctatttctccaagatgtagaatgtgaattattattcttatcacaagactctatatatgtgacaaaatagacatcaacaatttcatctgccgttttcaaataatccataacattttttctttcgcttgactttagtatctttcatattgcttgatattattgtgtaaaatatcacatactctaaatctgtcagaacagttttctattatgttctttaaatataggcttgacaaataaagggttaaggaatataattagattcagtattagacaaggagttaataaatatgcggcaaggtattcttaaataaactgtcaatttgatagtgggaacaaaaagtagcagtcccgtttcacttttaatatggggcttagttttttgtacccagtttaagaatacttttatcatgtaattttatatgcccgaaaacatataagtgttttggggctattggagttatttacccagtgataggagtatttatcactgggtatttttatgcccttttttgggtgttgataggaggaaaatcacatgaaaataattaacttaggcattctggctcacgttgacgcaggaaagacaacattaacggaaagtttattgtataccagtggtgcaattgcagaactagggagcgtagatgaaggcacaacaaggacagatacaatgaatttggagcgtcaaaggggaatcactatccagacagcagtgacatcttttcagtgggaggatgtaaaagtcaacattatagatacgccaggccatatggattttttaaccgaagcataccgtgctttatctgtccttgacggagctgttttagtcatttcggcaaaagacggcgtacaggcacagacgcgtatattattccatgcgcttcagaaaatgaacattccgacaattatctttataaataagatagaccaaaatggaatcgacctacagcgtgtttaccaaagcattaaagacaaacttaccagtgatatgattgtcatgcaggaggtttccctgtcgccccaaatatccatgaccgatatttctgatttggacaaatgggatatgattatttccggaagcgatgaactattagaacgatatgttgcagaggattctttggatatacaggaattacaatatgaaaagtgcaaaagaaccagatgctgctctttgtttcctgtttatcatgggagtgcaaaagacaatttaggaacagaaaaactgattgaagcggttacagaaactttcattacagaaacagacgatattcagtctgaattatgtggatatgtttttaaggttgagtatacagagcggaaaaaacggctttcttatttacgcctgtatcatgggacgctccatttacgggataccctgctgctgtcaaaaaagaaaaaaataaagattacagaaatgtgtattccgtcaaatggtgaaatcgtcccggctgaccatgcctgtccgggagaaattgttattttagctgatgatactttgaaactgaacgacattctgggaaatgaaaaactcctgcctcacaaaacatggattgataatcccatgccattacttcggacaacggtagagccgcaaaagccggagcaaagggaagccctgttaaatgccctcgcagagattgctgatacagaccctcttttgcattttgacattgatactgttacacatgagattatgttatcttttttgggaaaagtacagttagaagttatttgttcgctattagaagaaaaatatcatgtgggcgtggctatgaaagagccttcggttatttatctggaaagaccgcttagaaaagcagaatataccatccacatagaagtcccgccaaatcctttctgggcttctgtcgggttgtccatagagccgctccctattggaagcggagtgcagtatgaaagcagagtttcacttggatatttaaatcaatcgttccaaaatgcggttatggagggggttctttatggctgcgagcaggggctgtatggatggaaagtgacagactgtaaaatctgttttgaatatggattgtattatagtcctgtaagtacccccgcagactttcggctgctttcccctatcgtattggagcaggctttaaaaaaagcagggacagaactattagagccatatctccactttgaaatttatgcaccgcaggaatatctctcacgggcgtatcatgatgctccaaggtattgtgcagatattgtaagtactcagataaagaatgacgaggtcattctgaaaggagaaatccctgctagatgtattcaagaatacaggaacgatttaacttatttcacaaatgggcagggagtctgcttgacagagttaaaaggataccagccagctattggtaaatttatttgccaaccccgccgcccgaatagccgtatagataaggttcggcatatgttccacaagttagcttaacagcttgcaaaagtcatataaaatgagatttgaaaggagaatgtaacttcatgtttgctaaaaattcaaaggcatattctgtctacctgctgttccgatttgtctgttccctggcggtttctatgtccacagtgctttccatcgtgtaccacctggaggtggtgcagctggatgctttccagcttgtcctggtagggacggttcaggagacctcctgctttctgttcgagatgcccaccggtgtggtggcggatttgtatagccgtcggcgctcggtgctgattggaatgttcctctacggcctgggctttctgatggagggtgcgctaccgtggttcgcgccggttctgctggcccaggttgtctggggttgcggtgataccttcatcaccggcgctctggaggcgtggattgcctcggaggaagaggacaaacccatagacaaggtgttcctgcggggcagtcaaatggggcaaatcggcggcgttctgggcgtggtgctgggcacactgctgggaaacataaacctgcaaatgcctctcatcttggggggcagtttgtgcttgttgttggggctggtgttgggtcgcatcatgccagaaaccaacttctcccctgctattgaggaacggcagggcttgcttaaagactttgtctgcctgttcaagctcaacctgggctttgtgaaaggcgcacctgtgttgctgacgctcttagcaatcacactatgcgggggacttgccagtgaaggctttgaccggctctccaccgctcattttctggatgacacggtaatacccgttatcgggccgctgaacagcgtcacttggttcggtgttatcagtcttatcggcagcggcttaggtattctggcttctcagttgctcatcgcccgcatggagaaaaaagggactgtcagccgaaccagtgtggtcatgtccaccagcgccgggtatatcctgtgcctggttctcttcgcggtggggcggagcttttggttcatgttgttggtgttcctgctggcggggcttatgcgcaccatcaaggagcctgtgctggccgcctggatgaacgaccatgtggatgagaaaatgcgcgccacagtcttttccaccagcggacagctggactctttcgggcagatcatcggcgggcctattgtggggctggtagcccagcaggtgtccataccctgggggctggtctgtaccgctttcctgctgttgcccgcgctgttcttagtgccggtggcgggaaagaagcgggattgatatggcatagttaagtttactgacgagcgggagattacttccgctcgtcttcatttagtagcgcaaaatttgaggactctttatttccttattcggtatagcggaggcggctgtcaattcgacataattttcttgtgatactttaccgtacatgagcatttgtttcgtatttgaaagaacaaactcaccaaataaaaaaaacgatattcgggtgggttattttgttataccctaaattaccctctgaatttgtttttaaatttggagggatttttttatgtccttttttcgggcagttatctatctgctcatacgaagcaaaatttatcaatacatagcatatcagagaacggcaggaaaccagttaaaaaaatttctgccagtgcaacggtacttctcaccttgaaagtagaagtacaatctccatacaatagaattactatttcctataaccgtaaaggtcacagagcctttgcggtttttcttttgtcgatttttgttggaaagtgccgtagggctgtttctgatatgcggtgtcgttctccgcctctccatctggattttttacatttcaaaaattcagatgggaggtatttatggtgaaatatgcaccaagaaaggtatatatcagagaaagtggcggctatgtggaattatcctacacggagttctgccgttgcagggaatccgaccagacctatatggacaagctgtttatccccattcaaggctgtctgcttgaagtcgtgagggagcaatacacagacttctaccgtgacaaggaacggtggcgttatctgcaaaaattagatacaaagaatagactgctatctctcgacggatttacggacagcgaggggaatcctctggactttatcactgatgaagcggtggacattgcagaaaccgttgtcaatgcggtcatggtggacaggctgaaagccgccctgcctttgctgtcggatagtgaacaggagctgatacaggcaatcttttttgacggactttccgagcgtgaagtcggggcgaggttgggcataacccagagcgttgtaaacaaacgcaaagccagaatcctaataaaactaagaaagataatagaaaattaaaatttaaggcgttcagcccccttgttttttcctttgggaagatgagggggcttttctctgccctctcaatcaattctgattggaggaagtaagaatggcatacaaccacggacgggaggacaggaaatggcgtatctggaaagaagcggaggaaaagctgctgcgtgagtgcggcgttgatgaagcgaccattgagcagatacgcatggcggacagggcagacttcaattccaacaggcggttttaccgatggacgaatgacgttgcggaatatcttgaggacatggcaggcagggagcggcaggcggaagtgggtacggttgcggagttactggaagagattgagagcgaaaatctctatcaagtattagtcacggtggacgggcgtaccttgaaaatcgtcctgctgaaaatgcaggggtattccacaaaggagattgccccgcttgtgcatttgacgactggtgccatctatgcgaggttagaccatctgcggaagaagctgcggaaaattttatagcttctaaaacagcctgccatcctgcgggctactgggtgagggatggaaatcccctcactcattttttgcaggaggacaacaggatggcatacagggttaaggcatgggaagaacctatgagtctatgatggaggaactggaagtaatagaaattctttctactgcttatgatggtgacgaatttccgggttatgagaacataagattgagtttttcacaactggaaacgattattcggaataaacgcagcggttggcttgatgctttgagaaatcaaaaagcagtttatcttataactgataccagcaacggaaaaatgtatgttggctcggcaactgctcagtatggaatgttgcttcaaaggtggactaactatatagacaatggacacggtgggaatgttgaacttaaacatattgttgacaccaaagggtttgattatataaaagcaaattttcagtattcagtattagaaaactataacgcacgaatggatgataattacatactgagtcgtgaaaaatggtggaaagataccctttgcacaagacaattcggatataataaaaactgataaaaattagaccgtcagatctcattcgagacttgacggtcttatatttttttactgtatttaagaaaatcgttttggtgttcctgtttgcgaagttgatagccttgtgcaatcagcgtatctactttcagagcaattaggtttatgtcggaacacattgcccgtgcaatctgctgaatgtcatagccgttttcaatgtattccaaaatggtgtcgtccgggagcgaagcctgagaagcgaagatatttgcttcatactccatacggttctctctcatatcaaagatgttgaactctttgaacccgccgacagcaaccgcttcttgcctgtggagaacatcgtgtccgatttcgtgccatagcactatctgttccacgaccgggtgcataccgtttttaaggaaaacaaagcggttcttcagaatgaccttgtatgctccacgctgcttttcaaaatctcggtagataatattgataccaagctcttttgcgaccttgtacgggtcacgagtaccgcaacggtcaatgagcttgttgacgattttcacaatttcagccgtagtgtaataccccaatccggctcacctcccatattatagtatatcggatatttaccctataataaattataaactattgtgtgtcccatatattggacttagttcactgtgaggattactcgtctttgcggtatttcttcggggtgtattttttattgttcttctttgcaataagatatgcttcctgaatagcgtcaaccatttcacgcatatcttcgtcagccatttcgccgccggcaaacagaccggtaacttctgcaagcaactcctgagcctgtcttgcccctctgcgtccgtatttatcctctacatcggcgatgaaagcgtcatcctcagacagcagataattcacatttacatttaatgcttctgccagcttcttgtatctttccgttcctctcggacgggatttatcattttcataagaacaaattacacgtcgggttacgcctattttttcagccaattcatcctgattaagaccgagtttagtcctctctgctttgactttttcaccgaatgtcatctttgatttcactccttaaaagaatatttacagtttaacttctcatttactcttgacaagtacacttaaactgcgtataataagaaacaggaagttgaactactcatagtttacactaaacttcccaaaatgtcaaggggggttcaaaaaatgttacgaagcatacttcattgtgatatgaacaacttctatgccagcgtcgaatgtatgctcgaccccgcattgaagaaatatccgattgctgtctgcggctctgtggaggaacgacacggtatcgtgcttgcaaagaactacaaagcaaaggcttttgatgtgaaaaccggggacgcagtatggcaggctaaacagaagtgcaaggacttggttgtagtgccgccccattatgaggagtatatcaaatactcaaagcttgcgagaagcgtttatgagcgatataccgaccaagttgaaccgtatggtatggacgagtgttggctggatattagcgggacagaaagccttttcggttcgccggaaaaggtggcaaatgaaattcgtgaaacgatgaagtttgaactcggcttgacgatttctgtgggtgtttcctttaataagatatttgcgaagctcggctcggatatgaagaaaccggacgcagtaaccgttataccaaaggatacattcaaagaaaagatttggggacttcctgccgctgacctgctcggtgtaggacgggcaacccagcgagtgcttgacagctattgtattcgtaccatcggggatttagcgaataacgaccctgagttcttacgcagaagattaggaaagaacggagtagttttatggaactatgccaacggcaacgacctttcccttgttgccaagaaagatttcgtttctcctataaaaagtgtaggacacggtataacaacagtagcagatttagagaaaccggagcaggtgtggcccgtgtttctcgaattaacccaagacatcggacacaagctccgtgttcacggactgagtgcagaaggtgtcgcaatacatattagagacaacacgctcaatacaaggcaatggcagacgaagattgcacttcctacacagtctccgatgattattgcaaagaccgcttttcagttgtttgaaaaaagatatgggtggaataaccctatccgttctgtgacagtacaagccataaatcttattccacaagacacgccccgtcaaatagatatgtttatggacgccgcaaagcaggacaaattggagcgaatggaaaagtgtgttgaagaaatcagacggcgtttcggaaaggacagcataaggaatggggttctgtgtcagaacttgcggctaccaccggaaaaagccgaaatcactatgccgacaggtatggttggttaaggaggtctaaatgtgattgacgaaaaagaggttacggcttatgttacgatgcccgactgctttttgcaggggtgcagcgaagatattgttatctttcgtgcggacggcggaaaccattttaccgactacggtatatatgagggaatgtttcttttctttgaccggaaaaaacgctttaagaaaggaaggctttcctgttacatcaatactgccggagatgaccgacccaagtacagggtgtcggataagaacatcgacggatacaagcacttgggaagattagttttgactttgagaaattacgaggaataaaaatggaatccgaaagaagaaaagtttatgttgaagtaaatgtaacacatagacctgatggaacggctcgtccgaacttcatcaagtttgagaatgatgaaaaatatgagatagaccgtgtaattcagaaatgccgtgcggcttccaccaaagtcggaggaaccggtatccgctacacggtacagatttgcggcaagcccacatttctgttcgacgaagaaaacggaaagtggtttgtagaagcaaaatcctaatggtaggaggttttgtaacttgaaacatttatcgagatttgacatcgaagcgattgccgacaagtatgttcaggcatatatggcacttcccgatgtccgtaacacacaaatatacagaattgacccggagcttctcttggagaaggttctcggattgaatgtcgaataccagcacctatcttatgacggtagtattctcggaatgacctcatttacggaaatgggtgttcaggtatttgaagatgatgataacgaagcctttttctttttggatggaaaaaccgttctcgtggaaaaggacttgaactttgacagcaagctgaaaggcagaaagaatttcaccttaatgcacgagggcagccatcagatatttaagatgttgttcccgaatgattacggtgtgacacagaaatctgccggagtacattattacaaggcaaattccgagagaaataagcctatatccgattgggaggaatggcaggcaaatacgcttggagctgctatccttcttcccgaaaaccttataaagcagggaatgtatctgttcagtcttggagaaaagattgagtgtctgaacaaaatatactatccgagcgtatataagagatttgatgcacttgcggattttttagggtgttccaaaaaagcacttgctatacgaatgaaacagctcggacttttgaaaaaggagtatcttgataatccttttgatttggttacggtttatccggaggtgagcgagctatgaaatcgttggaacaaaagataatcgtaaggtgcaaaaactgtggctggcgtatttttgacaaggtaacaatgacaacaggcgtgattgaactgaaatgtccgaactgccacagagtagtagaggttgacctatccctacgcaagggaacagtcaagtacagattaacaagaagtagtaacagagcgaacaattaaatatcggacagatgtaccgagccacgagtccttgagcgaaagctcttgagtcatcaaattgccggacgctgagaattaagggatagaaatatcctaatgttcttggtgtccggcttttttgtcgctcccgaaaggagcaagaccgtgacatataagtggctggcgtatatcgccaagtatccgtaatctccgaatttttgatttcaaccaaattcaaaaattcaaatttaaggagattacgacaatgacaaaacttacattagaacaacaggaattattatttgcgaacgactgcaagctcattaacctgcggtatgaatatcacggctacaccggcacggagaaatgggcgattgtaacagaactggcggaagaagaattgtgggttaaataccctgatgttatccgtcggtacactccgttcattctgctttctatggctcagggcgaagtgataacggagtatcagaactacgaagcaagagagagaatgagaaggcttcttttcggacacgcatttgacatcaatgacggagaatttgaagtgcatcatccggaattggcagtcgatacagacccaatcgaagaaataatgctgaaagacaatattaagcgacttcgggaggttttgtgttacttaagcgaaacacagaaacgcagagtttttaagtatttcttctacaacaaaacacttgaaaaaatcgcagatgaagaaggagtcgattttacttctgtaagggaatcggtaaacagtgcaataaaaaagttgaggaaatttttctaaaacaccccccaaaaacgctctcccatttcaaacaagtgaaggggttaattctaatccggatatgaattacctcagaataatcgaaagcgaggatttacatatgaaagaaaaagaatttaagaatgtcagatggggcgatatttattactgcgacttgggggttacaaacggtagtgtgcaatcgggaatgagaccggttcttgtggttcagacaaatcgcttaaatgaaagcagtcctacggtcgttgtagccgctataacggctgttaaaaagaaaacggcaatgaatactcatattgagctaaacacggattgtggcttaaaagagccgtcgatggtaatgcttgagcagctacgcaccgtggataaagccacagagcttgataattttgtcggaagaattaccgacgcagataaaatcagcgaaatcaagcgaggattgaaatttgcagtcggtattcccgttaaacccaagacagagcgtaaaggcattgtactaagtctttgccctcgttgcagaagcgagtttcagtctatccctgaaaacattgtaaaaagacttgacccctttcaggcagataaagagatgtgcgataaatgtcaggtaggatacggctatgactatatgattttcaaaaagaaccatcatcacgctaagggaggtgttgacaatgtttgaagataagattgaagcaatgaacaaactacccaacgctgttgatgatagttccggctttgagaaaagagtttatacggtagaagaaataatggatattctcagcattggaaagaacactgcttatgctctcgtcaactcaggcgttttccattttgtaaaggtcggcggacattacagaatttccaagaagagctttgaccgatggcttgataatatggacagcgaaagctccggttgtcaattatgcgattaaaccaatcgcataattaacaaaaactccgattttcagtaccatatagccaagtcacttggctatatggtagtcagagtggcaaataagaaatcgggggtaaacggtaatgcgaaagaaaattgaaaagagcgatactcgacttcctaatacattcaggcagactgaacctgatatacgagcatacacggtagatgatatacagcacatcttgaaagtgagcagaactaccgtctatgagctgcttaaaagcaagaaattccatagcgttcgtgtcggaggtcaatatcgaatatctaaaaagagctttgaaaattggctcaatggcgagaaaggaggttctgaagatggcatttgttaatatgttcaatgaccgagtggagcagtttaatctcagagaggaaaatgaacgcttggcagaattgttcagcgatgaaaagcttcaggaggaagcacagtggcaagcctattctgtcaaggaaatatctcggttgttttccatttccgaagaagaagcactgaaactgatgaattgcggcttattcaaaacataccgagtcggcaacgaatacagagcttcaaagaaaagcgttgaagaaaataagaaaatcgtcaaggcagttcttacatatcaggacaaaaagacaatgtctgtacccgacgtaatgagaatactcggtcttggaaagacggctacataccgactcatcaatcagtgccgatttaagacctatttggtactgggcaaaatgagagttgatgtggatagctttgaagattggtatgcaggacaattccattatgagaaagtaaacggcgaaagacccggtaagaaatacggcaaaacgctctctcctcttactgttgcaaaggtactcggcattccgagaagcaccgcaaatgaccttatgaacgatggcattgttgagtttatatgggttgacggtaaacgccgaataaaaagagaaagctttgataagtggtacgcttcgcaaagtaaatacactaaagttaaggaaatcgaggaggtggagggatatgtcgattgaggatagagttcgtgaattaaacggcggtacatatacaaaaaagagctattccgtagaggaagttcagtcaatcttgggtattacccgacagaccgtatataagctcatcaaacaggggtgttttcaggcagtaatgctcgaaaccggataccgcataataaagaccagctttgataaatggctggataatgaataaggaggaacgactatggcttctattgtaaagagaaagaatcgatattccgtcgtttatacctacaaagacgatgacggaaaccaacatcaaaaatgggaaacctttgatacaaacgcagacgctaaaaagagaaaaactcaaattgagtttgaacagcaaagcggtacattcatcattcctaatgctacgacagttgcggatttgcttgaagaatactgctccgtgtacggagtaaataactgggcaatgtcaacctaccgttcaaagaaagggcttatgtataattacatcattccgcttatcggcgatgtgaaacttgatgaactgactccgagacttatggataaattctatcaaagccttctgaaagttaagaccaaagtggtacagaataaaaagcctaaaaatgagtatctgaccgtacataccgtaagagaaatccataagtttttaaggagtgcctttaatcaggcggtaaaatgggagttgatgacaagaaacccggttctcaatgcaacgctcccgaaagaggaacatcagaaacgagaaatatggacagcagaaactcttatgcacgctcttgaagtgtgcgatgatgatattctcgcattagccatcaatttatcctttgcctgttcactccgtatgggtgaaatgctcggtcttacttgggattgcattgatatttcggaggaaagcctgaaagaaaacaacgcttccatttttgtagataaagagcttcagcgagtaaacagagatgtaatggaggtgcttgataataaggacattatccgtgtctttccgagaactctgtcaaatacaaatacctcccttgttttgaaaacgccaaaaactaaaacaagtgtgagaaaaatcttcttgccgtcaaccgtagctcaaatgctgttagagagaaaaaagcagattgacgaaatgaaagagcttttcggtgatgagtatttggattatgacttggtattctgccattcgtcaggcagaccgatggaaggtcaggtaatcaaccgtgctttgaaaaagctgatacaggacaacgacttacccgatgtggtatttcacagcttccgtcacgcaagtataacctacaagctgaaatggaacggcggcgatatgaaatcggttcaaggcgactcaggacacgcccgaatggatatggttgccgatgtttacagccatataatcgacgaggacaggcgatataacgcacagaagtttgaggaacagttctacaacgctaaaggtctcaaaaatgcggaagaaggtaaaactgctccaatgcccaagtttgaaacttcggttgaactccttgacccaatggcagaggttcaaaaagagagcgaagttgaaaaagaaaagcctgctgagaacagtacagatgaaaacgccgccttgctcacaaaactgttatcaaatccggaaacagcagcattattaaaggctttagcgaaaacaatttagtcatacaaaaaaggcaatccgtcagggttgccttttgtaattcctgaaaaatcttgaaatcaagaagaaaaaccattataatatttgaacacagattattgatttgcataagagaatgcgtaaacttcaaatgcgtttcctgtgatttatgggctacagattaactcaatgatgtttcccatatttctttgcatttgctaataccctgctaaaaggaaggcaaaaaaccacgaaaaattagcaggttttggacgagaatttactaacagtgaaatcccagaaaagccagtaaaatcaaggattttcggggatttgtagggagtcaaaaatgcccctcgggggcttctcctaagcggaacgtcgcaggttcgattcctgtcggggacgccatttttattgattataagtgagaaatttgttttttcgcttttttgtttctgctaataaaaataaaaaatcatgttagcaaaaatgaatttcccttgtattttttctaacaaggagtcgaaccgatagaagtcatttttctaacaaaaaaacgtcatttctaacaaactatataacgcattaaaaatagattaagacattataaactatttaaaatttaatattgagatatatttagccaatctttaaatacagggattggctttttatgtcttatatatttttaattcaaagaaaaaagatgataaagaaatgaaagataaaatcatcaaagcacttgaattttatcaaagatacaagaatcgcaaacgtacagggatgcgagataaagctgactaacaagggaatattatcagatgtttggacattggaggattttgtcactccccatctccacacctcccccctttaccagctatttactaactcaaaaagaaatgaatgttatgttaagtaaatataagtatttatatattaagaagttatatagaaatatataaatcgcacatttgttgttaaatgatattcatttgaataaaaacataaaggggttgaaagtcatgaaaaagatattatttgctttgtttattgttggattagcaatatttctaacttgggacaatgaagaaaaacatgctcaaaaagaaagaaacgttaagttgattgaagaaaatattcagccatatttgagtgattaaatgtaaaatcatatgattactgattgatttgctaaagaaaagtttatatataataaatcataaaaatagtataatagaaatgtaatcaggtgataaaaaaagaagaaggaggcgtttttatgactatgagaaaaatagaaatcaatattcctgaaggcatggtttcatatatttctaaaacagatgaagaagctgttttaaaacagaatacaatgattttatatccatatattcaggataatacaatctcatatggcaaggctgctgaattattaggtgttcataaattagatttgatagctttatatggaaaactaggaatagcatatctacaagaatcagtagaagaaattacctctgatcttcaatcaataaagaatttgaggtcaaatttataatgattattatttctgatacaacacctattatttctttgttaaaggctaaataatttgatttgttagaaaaactatttcatgaagttattattccaaaagcggtatataacgagttgatttcaaatgttaagtttcaaaattaagctcaaatcattaaagactgttcttatatttttgtggaagaagtcattgatacaaaatcgctaaatatatttagacgtgttactggtttggatgctggtgaaagtgaagctatcgttatggctgatgaaaagaaagctgacttgttattgatggatgaacgtaaggaaagaatggtggctaaacagatgggattaacaatcactggaacagtaggaatattattacaatcctttgatgaaggattattgaatgcagatgaaataagagaaagtataaataaattaaaagaatgtggaataagaataagtgattcattatatgatcttgttttagaacatattcaagaaaaataattcatataaaaaaatatacaaaataacctttcaagaagttggatatttatccagctcttttttctttctaatgaaaaatattttttatctttttcatggatagatttattgaaattcgcaccttaacaattaatgaaaattagattgtttttgtatagatgaaatgatagaatttaatcttgagtttagaagtaaaaatgccataaaatcgggtaaaccccttgatatataaggagttcacccgatttgtttttttacttttgatgtagtgtaatttctcttttttctaatattttaataatttttttatttcatctctttttctgtattttttattgagatcaatatcaaattcttctgatatgtcttttataatgctgtcattatatataaactgatatatgttcctgtctatgtttatacagttgtatttttttgcagtttctattattctgtctaccgaatatttataattcagtcttttttctaggagtcttatcatgacaagtgctgtaaaacatgttagaaaatgcccttctatatgttcttttgtccacacaaatgttggtcttgcttcgaaatttgttttactgactttgaaagtatcttctatttttgtcagacctctgtatatttttcttatttcgtagtcatccagttcaatttcacttgttacgatggaataatatccatcatatttttcttcttcttttatcttttcttcatctaaaaagagttctttttctgttttgatttcaccggttgttctatcgaattctatattactgatatatccagcagcaccgtatgatgttgcttttgtgtatccagctggatttttgatcatctcttttgcttttttgatcattctgtttctgtcgtttcgctgtttcatgagatatttgaatgaaaaataaaccatctgtttttgacatacattgacctttacttttcttttgccgtctcttgtaattttgatttccttggaatacactcttgatttatgtgtaaaggcaatctttttattgttttcatcaataatatctgttttataccctttttcatcaagtacccactttttaaattccttgtctgctcctcttacagactgtccataaacatatccgtctctttttgaattttcatcattattgaagccggcaatataaaatatattatctgatgtattcagtcccctgtctgctacaacgatggtacgttctataccaaaatcagcttttgtttttttcagtataggtcttaatgatgttttttcggattcattgcctggaaaaatatcataggacatgggaattccactggaatccatcaaaagtcccaattcaataatagggtcgggtcttttgtttttttctggaccgcgttttctcatgcctttttcaatgatttcaccattttcatcaataatatcatcatcattgtattcaatctcgaaatagtagtttgtacagtcataatagctttttgagcagtctctttgatagaaatcttttgatttgtcccagagtgttatttagcactttatattaactagaatttatcaaattattttaactggctttttccattattttgactaattagttatgacaatcacactattttacttattcccgtcaaattacgccaactataatttcaatataaaaagatagtaattttgccttttaacagctaattactatcctcttttaatattaaactttatactgtattctctgatgaaaattcaacgttatgcctggtattgtgctatatgagcgcttattatacttaatccttttgctatcgtcaatccatcaataatactgttcatataacaggctattttttcactattccagaaaatatcatccaaactgctaagttcactggatactccaatacctggaatatccagccatctcttcatatcaaagttaattacatatacacgatacctgcttccccttgcgcttactgtaaatccagtaattctatcatcgatacttatatcttttaacacacattgccatgaagtgttcttataattacatatataagttatttttttatccaatctcatttgctgcctccattacaatttcattatcaatagtcattttttctctggcagctcctattattaaacaatgagtcagaagattattgagtttgcgtgatgatccctggcaggcattgctcagtgctttaactgcctctggtaatatcaatggctgtgttcttcctgctttctttagtttttcaatgatgtatctgcctatatcatcttcattcattcctgacatttcatactgaataacgattctctgtttcagtgcttcgtgtacagctcggttgattgtatgattaagcactggagttcctgtcatgatcaaaatgacataattacttgaatcaaaattaaagttaagaagcatgatcagatcattgagaatagctgtctttaaatattgtgcttcatccaggatgatgacaggtatgatccttttttcatcaactgtacttttaatatagttttgtatatttctgaagttgtctatttttttatgcattggttcaagtcccaactgactgcacagttcacgatagaattcaatcgtcgtaagtgttgacataggcatataaacaactttataaagtccaggattcagcgattcactaaaacttttcataataaatgtcttccctgtaccacttcttccagtaaaaagtccaatgcccctgatatctttgagatagttgagtcttcctattgcttctttaaagtcatctgtatctatttctatatctggctgtcccttttcaaagggattgaattccatcccatagtatatcttgaaatctttcatagctgttcctcctgtgcaaataaaggcctttttcgttttattcttgaattatcaacctttctgacctcatatatttcgatatagctgtcattttcatatatgaaaacatgacttagatcagggacatatttaattgtgactcttgttccaatatattcctgttttgtttcatagatctttgtattgagtctaatcgttgcatcattgatgacttttctagtaactgtatgatagaatattttttccagctgctgacgatcgatcctctttatcatatgggaatcattcataaatacatttacaggcgtctgcccattcaaagcggcatgtggtgaattgtttttctgattgacatatataccaaaagctttatcgatatcatcaattgttttgaattgggagaaatctgtattgtacatccactgttcttttaccgatttgaaagctcgctccacttttcctttttgattgccatgataaactttggcgtggcttatttggatttgcagctgagcacagatgataggcagttgttcatttttataaggagaaccattatcagtaaatatccttttcggtatgccaaatttaccaatagccctttttaaaacagtctgtacattaacggcattgtcttccagaaaaaatccatagccaacgatcattcttgagcgatcgtcaatgatcatgatcagataggtccttaacttacgaccgtttttattagtgatataagaacagtaggtcgtatccaattgccacatgtcgttggcatgttccatttcaaaggcacgcatatcttcgacaggaaggcgattcagttctggccttgaagcaatgaatctcgatactgttgaaagtgaaacatcctttttcagaatatcaccatcctctattagcttcagatagacagaggtcgctgtcattctcggattgtcggtttttagtttgattattttttctttgatgcactttgtaagcttgcgagaagttcctttatctccacgtattttaggcataagtccatcaaaaccatacttgcgatacagatcgtaccagtaacgaatggtttgaaaagagaattctttagatgttccatcaggatactgaaagggagtagaagaaattctcttataatactgcaaggcagaacggtcaggataggtttcgttgagaacgggaatgatctgttcatacctgaaaagagcgatctgcatatttaaatcttctttttttacattattcatatagaatatacctcctgacataaccatataacacctatatcaggtattcaaaggaaacgttatgggaaaaagcaatcatgaataaatgatcatatttttcgtcaggatacgttgcataaacatggtatgatactctgcaaaatagctgatgatgaaatcaaaactgaggagatcacatgaagaaaagacactcaaaaaagaatcgagacgttccttgtgatattttagataaaagatgataagctttctgacaagttctattgaaaaaccagtgagtttggaaataacagaaatagaatcattggtattgcgaaaagaagtgataatcctgataatattaggattagacaggatgcggtaagggacaatgatgctgggaagaagtgcatgagtacagttgcagctttgacatttgatacgtgtaatagttaattgaacagtatcatttacatcaacctgcaaataacgagtgtaggtcgcatggttgtgaaaatgtccaacagagccacaagtgcatctgatatgggaataatttatttttttaatatcttctttataagagttttgatcatatttattgataaaagttgtttgaaatgataacatatagattgtaaaacatacgttttattttagaaaaagaaaggcaggagggcgatccaatgaccctttctttttttgtatgtcagctcctttatataataataaaatagttaaaataatttgcctatcattttatcaaattattttaactatttttctatgtttattatttttgtttgactaaatagctgttattttaattaaaataattcaccgaataacatacctgaaaagagcgatctgcatatttaaatcttctttttttacattattcatatagaatatacctcctgacataaccatataacacctatatcaggtattcaaaggaaacgttatgggaaaaagcaatcatgaataaatgatcatatttttcgtcaggatacgttgcataaacatggtatgatactctgcaaaatagctgatgatgaaatcaaaactgaggagatcacatgaagaagagacactcaaaaaagaatcgagacgttccttgtgatattttagataaaagatgataagctttctgacaagttctattgaaaaaccagtgagtttggaaataacagaaatagaatcattggtattgcgaaaagaagtgataatcctgataatattaggattagacaggatgcggtaagggacaatgatgctgggaagaagtgcatgagtacagttgcagctttgacatttgatacgtgtaatagttaattgaacagtatcatttacatcaacctgcaaataacgagtgtaggtcgcatggttgtgaaaatgtccaacagagccacaagtgcatctgatatgggaataatttatttttttaatatcttctttataagagttttgatcatatttattgataaaagttgtttgaaatgataacatatagattgtaaaacatacgttttattttagaaaaagaaaggcaggagggcgatccaatgaccctttctttttttgtatgtcagctcctttatataataataaaatagttaaaataatttgcctatcattttatcaaattattttaactatttttctaggtttattatttttatttgactaaatagctgttattttaattaaaataattcaccgaataacaataaacaacacagacagcaggctgaaagccgtaaaaaaaacagaaaatgatcattgacattcaaaaaagatgggaggaactcgaaaaaaagaaatacacaacaatagctaaagaattttcaatatcaaatattgtagctaaaaaatatgtaaatatgagtgaagaggatattcaattgttagacagtccaaagaaatacaaacaaagaaaaacagctacagatgactatatcaatatgatctataaaatgatcctggatggaataaagccagaaataatctttagctatgtcattatgaaaggatataaaggtacgtggaagtcattggataacagaattgtatacttattaaaaaataattttagtatttctctttcaatggggtggtatattaagtataaatatccagataatatcatcatcataaaaagaaatgaaatattaaaatacataacaactaaaaatgagaaaacaaagaaaaataaaacagttgaaaaaaacattcaaataatcaaggaaagatatccaattataactgaactagaaaaaatatatgattcgttttacagcacgatcaaggaggcagatactgatcagctagataagtttattgataattatagagaatcagtattaaaaggatttatagaaggtatagaaaaagatattgccccgatcaagaacgcaatatcttatccatatagttcgggatttgttgaaggaaacaacaacaaattcaaactcatcaaacgtattttatatggaagaagcaaaatagtcaatctttttaggaaatgttacataccatttttaatgaataataaagattttaagctaattgatattttagaacacaaaaacagcacaatttcttgtgctgtctaataagttcatttacccataagcgagtaagaacctcaacaattttaaaacttccttattttattaatcctataaatcatcttcaattgcacaagatttagcataagcagttgatttagcttcaaaaaaatcagttttgatattattagcattactataaatacttacccatttcatcgattcaggctctttttcataaccttcataaagtgttccaaaatttaatgatactgctcgtaaattccctaaataatgaatataatcactaatcatttcgctagttaatccttcgattcgatcacctaaaacatattgtccccatgaaatttcttcttcgacaccacgttttaacatttggcgatattcttttattttatctacagtaaacaaatctggttcttctttttgtaattcaagaataatatttctaaataaccaaagatgcgtattttcatcacgattaatatagcgaatttcctgcgctgatcctgacattttacccattcgtcctaaattataaaagaacataaatcccgaataaaaatatattccttctaaaatataattagccatgatcgtcttcattaaatgaaaactatctttattttcaagaaaagcattatactgctcaccaataaagttatttctttttaatagatgttcatcatatttccattgatataatatttcatctcttttagccggcgaacaaatcgtatcaagcatataactataactctgtgaatgtactgcctcttgaaatgcttgaatcgttaaacaaagattcacttcatttgctgtaatatattcaccaatattcggaagattcgcagtctgcaaagaatctaaaaatactaaaaaagataaaatcttatcatatgctgttctttcagcctcacttaatattcgataatcttggatatcctgagttaaattaatttcttcaggaatccaaaaattattcatcgcctggcgataccagctgctgacccatgcatatttcatattattaaagtcatttaaattagtcgtattaccattgatcatccgacgttttcttacatcaatatcaccagatgcattaaataacgcttttttctttaattccattttaacctcctatgagctgcatgattcacactcttcaatttcaagagattgactacgaacataatagatcgtttttactccatattgccaagcttgaagatacagatccaataattttctaaaagtaaattcattagtcatatataaattaaccgattgcgcttgatcaatatgacgctgacgaattccagcagctttaatgatccagttttgatcaatatgatgagcatttttataaagccaaaatgttttcatgttcaaatctggtgccacgcgaataatcatgctgccctttttttcttccataaaatattttttcataattggatctacagccgcactagttcctgcaataattgaagtcgaactagttggcgcaatagctaaaagatagccgtttcttaagccatattgttgaatcttcttttgcagcttttgccattttaaatcattatattggcgtttttgaaaatatgctcctgttgcaaagtcactacctttaaataattcatagctgcctttttctttagctagattacaagaagcttctaaagttaaataattaattttttcataaagatgatcaacaaactttaaatgttcatcactttcaaaagcaattccctgcttcaccagcatatgatggtaaccacttgttcctaacccaattggtcgatatttttgattagttattcgtgcaaaaggaacaggataataatttaaatcgattacattatctaaagcccgaacaactacattaataatatgttttaattcgtcatcatttgtaacatctattcgccctaatgttaatgaagcaagattacaaaccacaaaatctccaggtttagttttttcaactactattgtttcttgatcaactttaatttcttcataaggcaaaatttccatcgctttcatattttgcgctatttctgtacataaattactacaataaataattccttgatgaccattaggattcattttatttacatgatcacgattaaacgtaaatggtgtccccgtctctactaaagatttaataattaatcttacaacttctttaactgtcatcacgcgttttgaaattcgtttatctacaacacattcataatacttttgttcccaaacttcaccatagtaatcttctaaataatatcctttagcttcataaatctcatgcggacacatcatataccaaggtgcatctaaatcatttttagctaatttccaaaacaaatcagggtaacaaacagccggaaagatatcatgtgctttcatccgatcatcaccattattagtccgaagctgtaaaaattctggtagatctttatgccaaacatctaaatatactgcagcagcaccttgtcttacacctaattgatctactgcaactgcagtatcattaactaatttgatccagcgaatcaccccaccagcagcaccttcaaatccacggatactactgccatttgcacgaacttttccaaaataaagacccatcccgccaccatttttagataccttagcaaaattatcaacacttttatatattcccgctaatgaatcatcaactgtatcaataaaacacgaactcatttggtgaaatggtttcctggcattggacattgtcggagttgccattgttactttcaatgtacttaaaatatcataaatttctctagcccatttaactttatctttttcttttaaagctaaatgcatcgcaatcaacataaacatctcttggggtttttctaagatttcacgttgatgattttggattagatagcgtttcatgatcaactctaaaccactatatgtaaacaatttatcacgttcatcttctaaataattactcaattcttcaatttcatattgggagtaatgttctaaaatatatgaaccatagtagccttgtttagttaaaaatttaattttatcataaaaagcagtaatattatattctttcatttttttatctactctttgatatatatcataacttaaaaaacgtgctgatatcatttcccattttggagcttctttactagttaattcatttgctgcctttatcaacattgttaaagcttcttgaaaactcatctcttctttataaaaagatttaaatttcgctaataataattgtaaagagtattctttgtcgggataatctttttgaatcgtattaaaaatttctattaatccttcatcttttattaaagcaattaattcatttatgatatcccgttgctcactatgtttttgacgatataaaatatatgcctttgctacttgaagatatccttgtttcattaatgcctcttctactttatcttgaatcatttcaacattaatttgatcagctagatctttttcaacttcctcaataatcttatctaaatcagttttaccaataatttgatcaagactattaaaagccttttgaatagctagttttattttatttttatcatattcttgatataaaccatttcttttttgaattttcatcatttcacatccttaggtagccattctagcatactacttataattgcttcaatcgatatgcttttaattaaaattttgatcataaaaatcttcacataattgtaataaaaaatgctttttttcttgttgataaaaacgtatgatcaaaaaaattattattgtccctgccactaatgcacaaagcatatcagtcattgaatcatgtacaccggttttataatgattaatacagtcgttattaaacaagatcaacatcatatattcaaacaattcccataacatcgcaattgcaagatttgtattaaaaacaaataatataaatatcttgtattcttgatgatctatgatctttttttctttttttattatataaaaaagaataacagctaatagagaagcaaatatcccacttgaaaagtgtaaaattttatcaaaaaatggtaaattatatccgttaaaacagctcccaatcaatgatgcaaaatacataaatataatattaatgatatagattgctttggtagcctttaatttaaataagtaaaatataaagggtaacagtaatggtgtaatcaaagctacgaaccccatgaaaaaagctgttaaattattatttatataattaaaataaaaaccaataaaagaagttaaaatataaactataatacataactctagtattactttatcctttttttgtttaattaacattttatcgcctgccatcttattataatatacccattaatttctttttcgatctctttattatattattgtttaaaaaatatattcaaaattaattatgttttattatttatggataattagacttaatatttttaaaaataataaattattattaaaaatcgattaagtattgtaataaaaagtgttaaaataagaatagttaataatgaaggaaggaagtattattatgaataattttagtgatgatttaaaaaaagtatttttagcaggaattggagctgcagctttaactattgaaaaatctaaagaagttgttgatgaattagttgaaaaaggtgaaataacagttgaacaaggtaaagctttaaatgaagaattaaagcataatctttctaaaaaaagagaaaaaactgcatcagtagaaaaaattagcaaagatttagaaaatgctagtcctgaggatttagaaattttgaaagcaaaaattgaagaattacaaaatgacacaaacaaataataatcaaaatttaagcagtaaacgacgtcttattcaaattatcagtattttaaaaaagcatcatcttactaaagggatcgatcctgtcaaatttagaatcattctagaagatttaggtcctacttttgtaaaaatcggacaaatcatgtcttctcgacaagacatgttttcgcagcgttattgtaaagagttaatcaaattacgtgataatgttgctcctcttgatattgaaacgattcgaaatgtgattgaaaatgaatatggatgtgaattagaagaaatatttttggaattcgatgaaaatcctttaggaagtgcttcaattgctcaagtccacaaagctactttaaaaaacggtaaagctattgttgtaaaagttcaaagacctaacatttatgagacgatggaacaagatatttcattgattcgtcgtgctgttaaactacttaaaatcaatgaggctttaggtaacgttgttgatttaaatatcgttttagatgaattttggtacactgccaaagaagaaatggattttttaaatgaagccagatttgcaaatcgttttactgatttaaataaagatattgcctgtattggtactcccgttattgaaaccgattatacgactagtaagattttagtaatggaatacatagatggttttgaaatcgatcaatttgaacagcttttaaataatggctatcagcgcaaagaaattgctgccaaattagctgaaaactatattaaacaaattgtcgatgatggtttctttcatgctgatcctcatcccggtaatcttagaattagagatggtcaaattatttggattgattttgggatgatgggtgtattaaagccagaggacaaaactttaatgaaaagtgcagtcatggctattggtaacagtgatacccaaaaattagtagatgttattttgactttgggtaatcatgataatcgtatcgactacactttgttttatgatgatattgaaacttttatgcatcattatataaacgctaatttaaaagatataaacttaggagaagctattcaggaaatatttaccattgctcataaacatcgtatttcgatgcctaaaggaattagtatgttagcgcggggattagttactattgaaagtactgttatgttgattgatcctcatatcagtattattgaaattgctgctaatcatgtggctaaacatgtgtttagtcatgttgatttaaaaaaagagttaacatctgcgagtaaaaaaacttatgatgctttaaaatatactattgatcttcccgttcaattatctgaagttattaatatgataaaaaaaggacgtttgaaaatcaatttaaatattatggattctagtgtaccgttgaaatctattaatcatatggttaataaattgatcgttggtattgttagtgccgggttattaatggctagcagtcttttatgtacaacgcaaatgacgcctaaagttttcggaattcctgccttaggttttatcggttatatcactgcggtgggacttgggatatggttattatttactgttttaaaagaaagaaaacattcaaaataaagttttaactttgaaccaaatttaaaaaatgcaaaaattattattgaaaatataggagtatttactgaaaaagataaaatagtaaatacttttttaaagtgtttaatatatggaggtaaatagatgaaatatgattttgaaacattaattgatcgtagtgaaaaaggttctagtaaatggaatataatgaaagaaaaaaattctgtcattcctgataatattgccccattatctgtcgctgatgctgatattccattagctccagaaatcaaagatggtttaattgaatttttgaaaaatgatgttgttttaggatatacagatccaactgataaatactatcaagcagtaataaactggatggaaaaaagacacaactataaaataaaaaaagaatggatcattatttcaaatggtattgtgccagcattatatgatgctgtaaatgcctatacaaatgaaagtgatggggtaatcgtgtttacacctgtttattatcctttttatcaagcaatcaaaacaaataatcgacaaattgtaaaatgtccattaattaataaaaataccaattatactatcgactttgaaaagtttgtattattggctcaaaacccaaaaaataaaatggtaattttatgtaatcctcataatccagttggtcgtgtctggcaaaaggaagaattagaaaaaatcgctaaaatatgtttagataatgatcttattctcgttagtgatgaaattcatgaagatttaattatgccaggttttaaacactatcctattgctactttaaatgatgaaattgccaatattaccattacatgtactgcgcctagtaaaagttttaatttagcaggtatgcaggcttcaaatattattattaaaaaccctgatttaaaaagtaaatttattttacagcaagaaaaaagatgttttcacagcttaaatacaattgcttatgaagctacttttttagcttataacaaaggtgaaaattggctggaagaatttaaaaagttaattgataaaaattatcaattactagttgactatattaatcaaaacatcccgcaaattaaggtatatcctttacaaggtacttatctagcatggttagattttagaaatttgggttatgatcatcatgaattagaaaagaaaatgatcaacgctaatttgtatttagatgaaggatatctttttggtgaagaaggcaaaggctttgaaagaatcaatattgcttgtcctactaatgttttacttgaagcattaaaacgtctgaaaaaagaatttgtttaattttttataaaataaagttaaaggataaactattccaaaagtttatccttttcatatttttcaattatacagctgtgttctttagtctctttattataactgattcctactatcagtaaattatccctatatttttccaatccctttggatatttcttttctttgatttgatctatcgctgtctctgcttcatgatcccattttaactctactatcatcgctggtttatcatctttaggaataaacaccatatccgcatatcctttcccacttggcatctctcttattatcgtataatgatttcttgcatacatatacgcaatcgaaattgtataggataacgcattttcattattatatgttagtatcgctgtatctaaatgcgcttcttcgatatacttagctactaattcttcatctctattccatgttgcttctaataaggcgcgactgtttaataacgctttcgttgtttcattccagttagaacttcttatagaattaacaaatgaatcgataacttctttatttggtatataacatgtctgattggaactgttatatcctagataacctagatggatcagcagtgttaaaacatcatcttttgtatcaaatgttgtcatgtcattttgaaatgatgtcgtctgtacagcgacatgttctcctgccaacaacttcacaatatcatcttttaagccgtcataattcatatcaatatatactcttaaggcttcatatgtctcggttgcactccagtagttttcatattttctgtccatcaaagcataaacaacagaacggtggttataaactgataaatcatctgtcattctgtatccatcataccagtctttcattttttcatagtccatatcatattttaaacataaatcttgtacttctttttctgtaaagcccataaactcttccagtggggtgggattgaggatcgatacttccttgaacatattcaaggcactatgggttccatatttcttgattggcagaatccccgtcatataacataatgatacataaggtttgtcctttaacaggtttcttaaaaaatccagatatttctcttgggcttttttatctccctgatactctctaaagatgcagtcccattcatcgatgacaaaaataaagctattttgaacctgactgtatatatcattgagcactctgatgagttttgttttatcaaaatataacaaatccttatattccagaagcagttcccaaataactgaatcattcactaattgaatcatcttttcaatatcatgtgtttcactcaaaaaatcttgcatatttaataagatcacattgtatttattcaaatgcttttgatattccttactcttggctatctttagatctttgaacagtttcgatgaatcacagctttgatcataatatgctgctatcatcctggcatcagtactctttccaaatctccttggtcttgatacacaaatgtttttcatattcgtattgattatccgattagtatattctatcagtaatgatttgtctacatagatttcactgttaactgcttctttaaaaccataatttcctggattcaaatatattcccattttttcaccaacctttctttatctattatacactattttaataattaaaaaatcatctattaattcaatttatcatacagtaaattatcaatgatataattgattatgtattaatagattttattaaaaatataacaatgataaatttataaaactggcatgatttttatttaatttaaaaataagacatttagccttattttaaattaaatatatagaaattatatgtacagcacttaaaaacgataattaattataaagcttctttcaataaagaaccttatattctattcttattacttttctaattttttccatactaatttaaattcactccagattatttttcttcgccaaataacacctttgattattctaaatatatatacaaacggtctagcccaagaatgctgatatgcaaatggacaatatactttaaaaaaatctggattagtaggaaaaatacgtgaccataaatatttaaaacgagtctgattatctacttcttctttatctttatcttgtgccattttagataattcatttgttatccgttgttcaatatttccataaacaccggaagacaaaatataatccagcatttctttttgatctgaaagaagtttatcagaattaaaactatcagaaaaaacaaataaactcaatgatttaaaagcttcttcaaaatcatccgcttctaacttatgtaattctctttttatatactgccagtcaaggatatctttttttgatttgatatatacataacaatcaagtaaagaacgtagtccagtaccactatatttataatgtttataagtatgtataataaaataaatataaaaatcttcatcacaaaaatgccagccaaaaagattatcgtcatcttttataagtttttcttttatattaatataataagaatgccatagtatattatatgtaatactaaataaattagtatgcatttcaaaattataaacaggttctttcttgaaaacatcatgattatcaccttttttaccaagataacctcgttttctcataaaatcatatattttttctcgatattcattatcaaataaaatatcattatcagccatttgtctcattcctaattttggatataaatcttttaaaataattccttttaaaggcatataccatataccttctgcttccataaaattaataatttctaatcgttctcgatcaagtaataaatttttacgaatagctttttctctttcaagtttccagtgctttaaaagttctttatccaaaattaatgttttaacagattcaatagctatataacaaagtgctgctaaactatgctttttacacacaaaatataaagctcttaaatctgtgtcctctacccaatctttatcaggtatttgaccacttatcgcacaagatgaaagatacaacatgccatattttacattattttctgccaacattatgtgcctccacttagcgaatttttctccagcatctacgtgctaatgataaaatacgtaatacgcctgctcgaatataaaagaaatcacaccataaatgcacataaaaaagatattttttattagtaacggggataaattttccatctcttgtaattccttttaataccccgataatcatgtcatcagttattccatattctttagtataacaattatccccacagatgacatagtcattttcacgaacttttaaaatacgatgtaaaactaactttccatttgctcttcgatataatggcacatcatacttttttaatctgccattgggtttttcaagtaaaataatgtcctttctttggcgtaataaaggcatcatcgaatatccaacaactgtagaaatacagcttccacgatttgcaatttcttcagcaatattcacattacgaatcattcaaaaaaacctgctttttcaaattcattaattattttatcaacatctttttctacagtttcacgatcaacttcataacgatttaaaatattatcaatgatttcctctctcgttgtttcatgtaacaacaagctagcaatatatgcagccgtcttattattccgaacaattcctctaaattctctactagcatcttctgttgcgatcattactgattcaccagacatttcttgaataataaatccctcttttaacttcatattaataccttccttttaatcatttgttattttcattgcttcataagctatttctacagcttcttgagaaatattacatcccattttatatactggaatagaatttaataactgatcaattaaatttaatgtttggatgtaagcttgagaatcatccaaaggccgataagtttgttggagtatttgcataagcgcatcctttttagcaattttttcaatagtattttcttttgcctgatacaatatacagattccttgtaaaggaacacaagtattggtacttaagcgatgctttccatcccaaggtgttccataggcagttacaacaccattatcaacttttaacaaaggtttatcatcattgaccatatatgcccgacttttaaatctttccatccataatcttgcatgcgtcgatttacctgttccgctcggtgctgtaaataagtatcctttatcatctacagcaattacagaaccgtgaaaaagtaaaacattaaattgtggcattcgagttgcaattttacggtatactgctaaagtttctaaatattcattggaaaattttcgaatatttattccatgtcttttgtcttcttgggcagatttaattctttcattttcaagatcgttttcttctatttttaccgaaaaatcagctttttcttgtgaaagataatctttacataattcttttgtcattggatatattgttgatacttcaataactttatcagctaatttaattttaaaacttatcatattcttcctcttattttaagtatttgttataaacatcatctatttttttattcacttcagaaagcttagcttctaattcatctttctgtgtttgatattcagttgtaatattaccacgtcctgcttccatttccttacgatatttcctaacttctaataaattatttacaaataaattatctgattcagaaaagttattaatcttctttaacattgaactaaaacgatttttttcatatttttcattttgcaaatcagacccaatcgtaaaaataagatttcctctttgagttatcgcattagttaatatcgtactagctccactacgattccatgaaatagccccaggatgccatatgtcagttccagaatctaaagagattatcgctaaatcatcttctccatgatgtacaactattgaaaatccttgatttttaagagcttcatcatattcactatgataagaatttgctgtaaaatatacagattccggtaactcaattcctacttcttttgtcatatttttacatgatgttagccatttatcaacatcattatcatcttcatcccattttaaacaatactgccaacctaatcctattaactctttaaattgttttaagctcatacaatcatctcgtcctggaaaattagttggtgataatgtcaacattcctacaaaattatattctttcatcaaaggataaatatctgtataaatattttcatctacattagtaaacaataacaccacactacatatcccttgagcttcattattataattttcttctaaattagatagttgttcttctaattgctctttttcatctgttaatggtgccatttctgtttccatctgagcataataagtatctctttcattttctaaatgactttcacgccaaaaaaagaatatcaaacaagctatcgtaataatagctactataaaaacaacaatgatttttatccgttgtttcttatcaaaatcaattttttcttcttccatatttcttccctctcaccctcattaatatgtattactaattaataatacatattataaaaaatgacagacagtataggccgtctgccatctttatacaatatttatttaccaatcaaaaccagtagtttcaagtttttcctcaccaccaccatcacttgctgtaacaacatcttcttgttcaaaaacaactatttcagttactggctttatatatttttctttcatttccttcatatttaataccttcccttatcctaaaataatatatcttaatctatataaaattttaatctcatatttgtacttactaattctaacataaacatctatttgtttacaagtattatttgaaaaaacatcgataaaatgactttttttaggcatataatcattttattataaaaaaataaatcatataaatataaattttctttaatataattttttaattatagtttcatttgtaaatattctacccgattaatatttatatttgtaataatatctaactaattttagtcacaattcaagaatttttaaaactctaaataatctatgatatattatttaatccactaaccaatttttgtattttattaactaaatatcattcaataaatttctacaatttactttgcaaaataaatggggagaatctagttataaactaaattctccccttatttataatattaaaatcttaatctttccgccataccatcttgtttactacacctgtatatgactgaatcaattttactactttagtacttacattcttttcaatataatctggtactggtattccatgatctccttctaagttcatttgtactgccgtctctactgcctgtaataatgatctttcgtctatccctgctaaaacaaaacatcctttatccaaggcctccggtctctcggtacttgttctgatacataccgctggaaacgatcttcctatacttgtaaagtatgaactctcttccggtaatgtcccgctgtcacttaccacggcataagcattcatctgtaagtgattgtaatcatggaatcctaacggctcatgctggatcactctgccatctaatttgaaaccgctcgtttctaatcttttcttgcttcttggatgacatgaatataatatcggcatatcatatctttcagccattttattgaccgcattgaataatgaaaggaagttcttctcggtatcgatattctcttcccgatgtgcactcaataaaatatagcccttcgcttttaattttaatctgtccaatatatcagatgcttctatctcctttagattattcgctaatacttcggccattggtgatcccgtcacatatactctttcttttggcagaccgcattcatgcagatactttctggcatgttcactataagctagattgacatcagaaatgatatcaacgatccgtctattcgtttcttccggtaaacattcatctttacatctgttccctgcttccatatgaaagatcggaatatgcagtcttttggcactgatggcacttaaacagctgttagtatctcctaagatcagtaaggcatcaggtttgatctgattcatcagtttatatgaacagttgatgatattgccaactgtagctcccagatcatcaccgacagcattcatatatacttcaggatcagctaatttcaaatcatgaaaaaacacaccatttaagttataatcatagttttgtccagtatgtgctaaaatacagtcaaagtatttgcgacatttactgatcactgctgccagtctgatgatctcaggtcttgttccgacaatgatcagtaattttaatttaccgttttctttccatcttacatttgtataatctgtcattatttccattactactcctccctaatataaaaatgagttatcaaaactcatttttattaaatatcattgattcgttcttaattcttggcaaaagatcatactcctcaccaacaattgtaacatcaaataccatagctactaaacttaaccagatatattgatcagacaattttttaacaacatttacgacatcagccattgaaataaaatcatttgaaacataaccagaatactgatggtgtataaaatttttgctttcaaaatattttttaatatctttccatgcattcttatgactttttgaaggataatatttttttagaagattatcatttaaatcaaagtttattgcttttctgctctttttgacagtcatatcaaatacaaattcgataatatgattctaatgcatcttctcgatattcgatcgtatcgccttcataacgaaaataccacttgtctactatttttaaaaaccatgctgattctggcagatcccattgtgcagtcataaaagtattaaaatcttttttactgcctaagtacacgcctttagataattttttgacgcctctttttttaaaaaaacgatctactttttcatagcattcatcaatatcaatgttattttctttagccttttcttcacttaataccatttccatcatcatttttatcacttccttaagtatatgatacccaaattggtctatcgttgcaatacgatatcttatccttcattattatatacttcaacagaagtgctttttacttcttttttatacttcttcataatatgtatctggatgttctggatcaaatctctcatttgcccacattatcgttaccatatcactttctccgatattaataatattatgagtatatcccgttgggatatcgatcacttccagtttatctccacttacctgatattctatgatctcatcactatagatatctctaaactggatcagtccttttccacttactactaagaacttttcattcttactatgatgccagtgctgcccttttgttattcccggctttgatacattaacacttacctgtccatactcttctgtctttaaaaattctgtgaatgatcccctttgatcgatattcatctttaatggataactgaacttatctttaggtaaatagcttagataggtgctgtacagtttcttctctaaacttccttctttcatattaggtacactcaatgttcctcttgattccttaaatgatttgatgatatctgccagttctcccaatttaatataatgtacaggatatacttcatatattccttcactacatttagttagatgtccttctaatgcatttaagaattcttttattacatcatcgatataacataatggtaattcaacatcaggatcattgatctggatatcgattccattaacaatgttataacaccatgtagcagttacactgttgtagttaggtcgacaccacttaccaaacagattagctaatcgatagacatatacttttgaatccatctttttaccatgatgtaaaagatattcttcaccttcttttttgcttttaccataatcattatctctactagcctgaatcgaagaactgatcagtatcggacagttattatcatgttcttctaataaagagcacaatgattcagtaaaagaagcattgccctgatagaattccttaacatctttaggtctgttgataccagccagatgaaagacgaaatcacaatcacttgtatattttcttaaatcatcgatagtattatcaagatcataagtatagatatcttcgatatcgatacaatgagttctatctttaccatctttgatatttcttaatgtactaacaagattcttacctacgaatccattagcacctgttactagaattttcatttattttttctcccactctgctaattcttctcttactaactttacttctaataatttattctttacttcttctaatgtcatcaatcttgtattattagaattaaactgtgttaatgtgttcttactcattccttcaaaaaaatatttatcatagtttagatctcttttatctgccggtacccgataaaaattgcccatatctatggcattggcacattcttcatctgtcagcaatgtctcatacatcttctctccatgtctgattcctattactttgatttcattatctgctttgaataattccttcactgcttttgccagtacttcgatcgtacaggctggtgctttctgcacaaagatatcgccgctttctccattttcaaatgcaaataacactaagtctactgcttcttccaacgtcattacaaatcttgtcatacttggttctgttactgtcaaatcatttccctcttttatctggttaataaaaagaggtactacactacctcttgatgctaatacatttccatatcttgtacacatgatacttgttttcttaggatctactgtcctgcttttagctacgattactttttccatcatcgccttgcttgttcccatagcatttacaggataagctgctttatcggtacttaaacaaacaactcttttaacattgcattctattgctgcagttaagacattttctgtccctagaacattagttttaactgcttcgataggaaagaattcacagcttggtacctgttttaaagcagcagcatgatagacataatcaacaccatacatagcatttttgatagaatttatatctctgacattcccgatataaaacttaagcttatgaaaaacattaggatatttcgcctgatattcatgtctcatattatcctgttttaattcatctctagaaaagactctgatttctttgatatcagtttctagaaatctatttaatactgcattaccgaaggaaccagttcctccagtaattaataatgttttatctttaaattgactcatcctagctcctccttaatccctcttatatagatctcttgtatagatcttatcttctacatcgcttaattcatcattcattctatttactacgattacatcacttagtcttttaaattcttctaaatcttttatcactttactgttataaaaattatcttcttttaatgttggttcatataccactacttctattccttttgctttgattcgtttcattattccctgaatcgatgatgccctgaagttatcactgtctgttttcattgttaagcgatatattcctactaccttaggtcctttatcaattatcatttgcgctatatgatcttttctagttctgttactttcaacgattgcactgattagattttctggcacatctttataattagcttttaactgtttagtatcttttggtaaacagtatccgccatatccgaatgatggattattataatgactaccgattcttggatctaatcctattccttcaattatctgtttagtatttaatcctttcatttctgcatatgtatccaattcattgaaatatgatactcttaaagctagatacgtattagcaaataatttaattgcttctgcttctgtactgtcagtaaacaatattggaatatcttctttaatagcaccttcttttaataatcctgcaaattctttagctctttcactttgttcacctactactattctagaagggtaaagattatcatacaaagctttcccttctcttaaaaattctggtgaaaacattaaattatcgataccatatttttctttcattgattttgtaaatcctacagggatagttgatttgatcaccatcactgcatttggattgattttcaataccgattctatagtttcttctacagatgaagtatcgaaataattttttttggaatcataattagtaggagtactaatgattacaaatttggcgttattaaaagcaacttctttatcaagagttgcttttaaatctaagtctttagtttttaaatattcttcaatttctttatctttaataggagagatacgattattaatcatatctactttttccttaacaacatctaaagcaatgacttcatgatgctgtgataataatgttgcgatactcaatccaacatatcctgttcctgctactgctattttcatttttctctccatatacttttaataaaatctttaaatttcgctttcaatgaataacctgcatattttttcattacaaatttaattcctttatttttatactctatcttaaaatcatcataatcaattggtttttcagctggtcgattaagattattttgatatttaatatactcgttgctaaaacattgctctagtacaatatcattattttttttattaaaatttttaatatcttcaattatatgttttcctttagctgtatttaccaatatctcagatactccgttatttcttggaaaatccggcattattttttcaatcccccaaaaatctccaagagtaatatcagtaattctttcaattttagcaaactcacatttaaaacatttttcagttaaaattaaacgtcttaaaaaaagtctattatacatttttgtatcaaaagaatttattttttctttaccattttcaaattttgcataagaagaatatgactttttacatcctttatacctaaaagaaaaatcaacaagtttggatttattttttatttcaagccattgtacataatcaaaccaaatttttggctttggcgttccatgacaaatgatatcaattctaataagattagtatcatctatttttttattatgtatcaaattagttaaaactttatgttgacatggtgtaccagaaaataccactaatttaccttgttttaaatcagtaataacactttcaaataccccttttaaattactttgaacatattttgaaccattaaacttcaaacattcatctacagaatcagctgacatatgtttaacattaagattttcatcaaaagctgcaccatacacaattatttcatttttcgaatataatctaaaaattgtgttaattatttctgtaaatgctccacctgaagatgattttcttaatattttttcattatttttaaaagcatatacttctaatggcattataatccccctatcgttttaatataccatccctactacaagggccattttcaaattcaacatttttatcagataataaactagtagccaactcaacaaatctttgtgctgcaattttttcattccattgattttgaattgtaaaatatgcattctgtgcaatactatattgtctttgatgatctaaaagtaggctaataacttcttcatatggaatataatttttcttataatcatacactatcccattacaacccgaatctattaaaaatggtacagatcccatcgctttactagcaacaacagcacaagcactattcattgcctcattgataaccgcgccccatccttcattagagtcactagtagctaaaagaattcctgctgaaagcatttttgttctaacatcttctggtgacatacttcctaaaaatttaacatatgtttctaatttatatttacttactaaaacatctaagtctttccttaatggtccagttccaataatttccagctcaaaatcaatgtggttattttttaattcttttgctagcataattgcagtctctgggtgtttccattttaatagccttcctacccataaaatctttttctttgattttttatttaatattaaatcaatatcataattgtatgtcattggaaaatatccccatttaaagcatttcttaaaaaaaagcccacataatgctagatcacttgccgcatatgcacttaaacaaagcacatatcgcctatcacttttttttaaataataattcttaaaacgatctttgattccttttggagacaaaatcttatatttcccacctttaaaaaatctttctccacattcaaaaattattgcatttgtattttctaagcatatatcaatccattgtgaaacatatgattgcgatataattattacatcactattttttacataatgtatcgccctactcatcatatcatttgattcatatgctttgatctcaaaatcattttcttgtacccgccaaccaatattctttttctcttcatttaattttgctaacgaaataaaataaaattctatatttttattgcttactaactcattacaaaatggctgttgatgatgtgaaataaaatttgatataaaaataattttcattttttaaattgattcaatagacttttttaaaaaatctattgcttttttcctttcaagttttaatatttcggttgcatatgtaaaatccaaagaagttaaatttatcttatcttcatttagtttattaataaattgagattctaatttacacatttttaaaatagaccaaagacgcgctgactgatcagaagaatgattatattttcttttaaacgtaaaaaataattttttaaaatttattgaaaaaacagttccatgaaaagaatcagtacaaattatctccgcattttttataagatataaaaattcttcaggccctccaacaataacctcacatgattttattttttcaaaatctttataccaatatgcaaaagaataaaccatataatttgttgtttcttgtatcctttttatataatctattacaccttgatctggcttatccaaaaagaatagacatatatatttattttttttatctaattttgttgataattttttactccattgatcacttcctaataaaagcgtgggatcaacaatttgcggtactttttcaccaattaattcataaataatatcaacccctgatgattctcttacagaaatatttttatactcacctatatattttttataagtttttttattgtattcttctaatgtatctgttccaaaacttggtgcccaagcaattctttttttcttaggagcaaatctcaaaaaccacataggatttttaataaaccaacttccactccaaatttggtcactaccactaataaaagctatatacgaattcgtttttgcaattttttttaattctttatatgaataattttttagtgttatttcttttgtgataaattcattcatatatttacaattttctttaagtaatccatttttagtattttctttataagcatttaatatttcattaaatttatttcgatattttggatattttaaaaacatccagtatctattaagtctaaaattaattccctgcaatattcttccaaatccatgttctgtacgaattaataaaattggttcataccccaaatccttgattatttgttgggtggcataacattgcaaaatcgagccaaaattattatgccaatatgtcacttgtccaattttttttatttcatttttcatattaattaccaataacatccattttctacattatttgcatttttaggtttatctttatcatttggtcttacccaatattcgttataaaatttggaaacctcactattatcccatcgtgatccttttattccaaaaagaatctgtgttgcccctccaagatgtattacaatcttaccggctttctttaactttgcagctaaaggaaaaccatatgcaccacatcctataatcgcaacatcaaaatctatttttaatgcttcttcatacatataatccaaagcttcaaaccaacttgtaaatctgtcatctttttctccagcaattgtttgtactgcttttaaagtatataattcaaattcaggtaaaatatttttattagcaaaaattttatttcttcttttatactgctcttctattgttttattaaatggatgaataactaatatttttttaccttctaatgctgaagtccaaggagtatcttcttcataataaggttccaatgaagaaagatgcgttaacttcatatttttagaacaaatttcatttattaaataatcttgcattatagttttccaagcgcctaacaaatccacttccttagatgcatctatcataagattcccgaatttaattgcagttttttcaccatatggaaataaccctgcatttctgtatatagataataacggtttctttctaatccttttttttactcttaaattaattcctatagtttcagctgtaatatatgcttcatttgaaccatatcttgcaatcattcttggttttccatccaatatccacttttttattaattgattagtatcatatctatccaatatttctaacttatatttatgtttaacaaacctgtttaaatccactttatttaaaaaaatattaaattttgatttaaaaaaatatttaatccaaataatttttttcattttaattttctcctatcctttttcaatctatataatttatttgaattttaactttgatatgataagcttatttgcaatattccacaaatatttatactcagcagtataaaaattaaataaaataaacaatccatttggaactattatgcaaattataaatttaagaacaaaatttttgactttaaaatcaatagccattaaaataacaaaaatcaataaaagctgaattataaattttcctaaaaatttaccatattctataaatcttattttaaatttatgtttatataaaacataaggatctacccatagactagttaaacaataactcataacagtaccaataaatactccttttaaacctaaaatctgtgcccctactatagatataaaaatatttaatattgccatgatccagggtttatatctagtattccaaaataatcctaatgaatctacaaatgtacctggtatagatataattcctttaataaaaaaagcaagaacaataattgtcattgttatattatccaaaacatatttactgcctatccataattcaataaaaggatttaataaaaaaataaaacataaactacaaaaaccatatatccatatacctaaaaattgcattactctaaaaataaaataaactttttcagaactttctgtaacattcaaatttcctatgctagctgaagcagaactgaatattaacaatgcaaatgtagtaataattccaataatcattgaataattagaatacaaccctacccaaaaaactcctaaaaaagatgaaataataatattatctgtactattaataatagtatttccaaatttatgatacatcattgcttttaagtctttaaataatttttttatttctattctagataatcttgacttattattttttaaataaggataatatttattagctacttgactaattcttaaatttgataaaaaagtacatattaccattatagaaatatatataatataattttttgttataagtaaaaatataatttgtaatacattttgtaaaactaaaaatacattgcggttaataacattcatatattctttttggtcagcagtaataatcgaccttttataagcacaaaaataactaatagcagaatttagaacatataaaaaatatataatatgtaaattaggaatatcagtatcagttttaacaatataatttaaaaatggcattgtaattaagccaaacataattataactgtacctataattctataagcacgtgcataaaaattcatatatttacatattgcatcttcatctttttcagctaatggtttataaagatttattattattgcgtttcctattcctaaatcagataaagccaatattgataatacattagtaaataatccacttaacccaagatattctgttgataataaatgaataaacacggttctactaataaaagatagaaacatattaaatatttgggcaagtgttgaaatttttaaatttctaaaagtattttctgctctcattttctatctccaattctatattttattaataaacataatcatttctttaacaatattttcataattatagttattaaaaatataatcatacgctaatttactatttttatttacaaaattagaatcaaacttttctaattttaaaatttcgttagctatagattttggtgtctcatcttttgttatatataaaaatttacttatttcttcaggtaatgttttaaagtttgtagatacaataggagttccggacaatatatattctataagttttgaaggaaatccaaaaatatcggtataagagtttgaagtacgaatgttcaataatatatccgcttgactcaaaacactttttatttcttcattttttaaatatccacaataaataatattttcatattttgattgatattcctttactaaatctaataatggacctgttccataaatatgtaattcatatttattttcaggaagaagtgtaacagcatctaataattcctgtataccatcatatgaaatgagtgtgcctgtataaactatcctttttcttatatgttttttttcagataatgttaaaaaattttctttctcattatgtcctattttagttaacatgcatggatttttatctaaatttagataactaaaaacatctgaacttaatgcaagtgctccagacatattttttgctaatgcttctccaatcttataaaaatagtaaaaatataaatttctaaatccttttttctcaaaattacctaaagcagtgtcaatgattaaattaacaacagttaaattaaatctatttttcaaatataaaagtcctatttctatatcagcaggtgtattcaatataattatttttttttgataatttttattatctatacaccattttttaatataagaaacagttttatatattctataaaaatcatcaacaattaattttctcttagtaggcaaaatatcaattgtcattttttctaatttattagttgtatttttatctctaattgctttattaattgataaaacagtcaatgaatcaccaatttgcttatgcatttcgcaaagaagatttttttcataaacactatttttttctggcaaaatctgccctataaataaatatttaatatagccttttactatcataactcttctcctatatttgttttagcaattaaaaatagtgttgcgattggtacggtaaaatttgcacccccaacaagaatagctgcttctgaagatgattgagccaacaaaattaatatagacattattgccattttagatgttttagactgaaaatttaataaaattttcatagaattatataaataactgtacaataacactattccacttattcccaaagaagctaaaacacttaatggaccattatgagtatttgtaagatgataatttccaaaattaccaaaaaataaataatttttcaaatcatttaaaacttctataaaatatccttcacgtccagaataaaactctttacccattattactaaatcactgaaataattattttcatataaataagaatataaaaataaaaaaactattggtatcattaaacctataataatccacaattttcttatatttatactaaatggccagaaaaaatatattactaatgcaattgatactaacatacatgttcttgactccgttaaaaatattaaatatattaaatatactattaatataaataataaaaatttaattttttttgatttaatatattcaaaaaacgaaagcgtgattgatatggttaaaaaaatatatatggctgtagaattaggattgctatatcctaaatttaatagtgtagtcaatttttcatgcgtatatgcataagaagaaaatgataataaacaaaataaaataccaataaatacattaataccaagtatttcttttatagtcgtatcatctaaatcaataaaaaatacataaaaaataccaaatattaaacctaaataattcattatagcagaaaaatgaatatcaaaagtaaactttccaggatttaagatacaagaaattaacaatgaaactaaaatcaatataattataataaggtttttaaaattattttttttcaacccgattctatttctttgaatatttacaattgtatataaaaaaaggactatattaataatataaaatgaataataacataaacgttgaatagaggtaactgaaaaaggaatagctacatataagatagcttctaataaccacaatattttaaatccacttttaattacttttattttcatattaatcctcttcttctatatgattatataaatctacataatgacttaacatttcatttaaattaaattttttatttaatttaattactaatttctcattcataattttaaaaaaattaattttttttgtaagttcatctatattatgagattttacaatgcaagattcttttaattcaacaacctcaggacaagctgttgaatcataaacaatcgctggtgttccacaagctaaagcttcagcaacaaccaagccaaatgtttcctcaatagataaattaataaaaacatctgctaaagtataaaattttactagttcttctatattttcagttcgagaaattccaatcatattttttggtaaatcttctatctgttcatctaataatccaatcaaaataattacactatcatcatctattttttttgataattcaataaattcatttagacctttcccactattccaaacacttgcaactcctagaattacaaatttattttcaatacccaatttttttctcaaagtagattgaactggtttaaatacgtttgtatctataccattataaatacacttaatattttttcctttaaaaaaagaattttctactgtctcttttaaccaatttgaaactgtaacaatatgaaatttatctatagatgtaaaatattcttttttatcattaaagtttttaaatgttctatccctaatactgtcaggatatgtatttaattgcttacaattttggcaatgtgttttccatttataacattttgcttttgtaaaatgtgcacatttaccagtaaacggccaacagtcatgaaatgtccaaaccacattaacatttgatttttttaaataattgaaaagaattggaaaatttaaataatgtccatgtatattatgtaaatgaataatatcaggatttattctttttatgtatttaataaattttatagtgctaaatattgatccataaccttgtaaacaaaatttccgtgacataaaactatgtaaatgattatctattcgattacctattttatatgtgttatgtctattactattaccaattccataagctatgtaattttctatatttaaactatctaaatagtcacttatttctacagcaattttaccagtacttccagaaccacaaacagaattaatttgtaatattttcatacaatccccctttattttaccgataaaaattcaataatcttgttgccttgaatttcagctatcttattattaaaaatataattcatagctgctttacccttatctaataattcatcatgtggtatcgatagaatattttctaaagttttatttaatccatcaatagtttcattttctaatacataacaatatttataatattcatcaggaatacctggtaatttagtagtcaatagtggtgttccgcaagccatatattcaattgtttttgaaggaaatgaaaactttgtatattcttctttactatctctaatattgactaataatgaagccctatgctcatactctaaaactacatctctattaactcttccaaaaaatttaattcttttatcacttttagcatattctttaatttctttttcaaaatcaccagatccaaacaaccataattcaaaatcatttttagtcaacataaaacctttaattaacatttcaattcgatgttttttattaagcattccagcatacataattgctttttcttttttcaaattattatatttttcatttgtaataaacaaatttttatttgcaattccttcaatgattaaacaaggtttatccgacacaccaagttcatctttcatataacttgtcaataaaatatatttatcaaattttgtctgatatttaatctgtgaatttaaaaaatgattagaaaatatcttttttattcctgtaggttttcttaatgaaaaatgaaatttaggtaaatctgtaacaataacacatgtttctgttttgaatatttttgctaaaaaagtcactggtcgcgcaataaagctaaaaatagaacaacaaaaaatcactttgtcattttcatcaatattttttatcaaccaataaagaagtgaaaaaaaagtagaaatacaatatccccactgttttaaaaacgcaaaattaattgttggataccattgcgttgaaatccctgatttcaacatttcttttcttggtggaataaacaatttatatccatttgggaaagatgcaattgttaaaaaagtatgtgctgagatttcaatatttttattttcattcattcctgttaataatgaatcttcaaaaacctgagcagaaatagacggtttaactttgcttttattagcaatattattaaatgtttcatctgaacatatcgttccaatataatataatttcatgtattttctccattaatcaaactgccaaacttataatcatattcctttggctggaatggaataagtccgccacctgaatgaaatgttaattcactaaaaataactttttcatctacgttgtataaatcaactcttacaaatttaaatggttgtgccaatttttctgcaaccttaattaactcatctttattttttggcaaattttcattttcaaatccatcatatccatatttaacatctattttcatccaattaggatcatagatattgtcaaaacgctttccattaatttgcttattatgttgtataaaacctacttttccattaaaacaaaataatttaaactcttctaattcaccatttttaggttctaaaaattcatcacacataattcgcggttttatatttttataatttttttctctatcttttaaataaaaattctcttttaaccatgaattaaacttttgcttagcttcttttttattaaaactattaatatcattaacaataatattatatgatgaaccatgtgttgccttcatcgcaaattttttaggatacttagaaaaatcaatttcctcaaaagagttatatattcctatcactttattcaagtattcatcaccaatagtttgactaacgtatttacgtacttcatatttatcagtgtatttagcatactccaatttttcatcagaaatttttgtactacaaatatattcgttcattgttgtaggattttttaaatttggaattttaccaaacattataaaatataataatttactatgatttttatctgaaataaggctaggaaacttcataaaaaaatttattaccaagaccttcaaaccgactctaaccttcaaaaatctaacccctttcatttatatcttttaaatttgattttctagactgaatatatatcgtatttgatggaatttctcctttaacaacactttgtgctgcaattatagaattatcgccaattttactaccacgtaatatgatactaccggcaccaatccaaacattttttccaataataatttcatttaactcataatcattatgcagcacacgaccattttggattttatgatcatgatcgaatatcattacatttggcgctatgattgtatttttaccaatatatattctatccctacacgtaataatagtattagaatttataaacacattatcatcaataattaactctgctttatctcgaacatttatttctacattatttcgagttctaaaattatgtccaattaaacaacaagaagaattatccataactatttttgttgaaagagagacaaataaaatatttttataacttttctttccaatgaagcgaatcgcattatatccaactagtaatattttctttaacatacataccctttcaattattaaacatatcaatatattttttaactatattctcagtttttaacttactattaatatattcttttgcatttttacaataaagttgatataaatcatcattcatctcaattaatttatcaatagcacttcgaaatccatcttcatttccaaatttaataacataaccacatttattttcgttaatatcattccatggtgttgtatcactaataactaccggtctaccaattaataatgattctacaatagaatgaccgtaattttcacctgttgtaggcatataaaaagcatgatatttagatattatctgagtaactttatcatgttctatacttcctttataattaacttgaatatttgatggcagtttacttatttctatttgacacagcctccaatattcattgtcttcaattgaaccatatatatcatattgaacctgccctactacattttttagatatttaattgctccaagcaaattttttgtaggatgaatccgagcaacataaattaattttaaattaccagaatttttagtaattaaagtattattataggatacaattgataagttatttatattatatatcctatcttgtttaatctttataaagtcttctatatattgtgattcttcttttccagtaccctgaaaataaatattttttaataaaccaaaaaatctaagaagtaatgtatataattttttctttttttgaccaacagctaatcgttttggataaaattctcctctaggagcaataatgactttaatcccatgtatttttgcatattttaaaaccggaaaaacatcgtcataactaaagaaactgttttgatatataacatcgggttttatttcttcaattaacttcgttaattttgaagatgttctagttccataaccaaaataaaaagctttaccaaaataaaaatcgttccaaccatcatttatatttggcaaaggctttttttcattaatttcatgattttttgaaataatatatatatcaaattcatcatatatactatcaactagattttttatacttactggtggcccaccaccatttttttgaggataaaataaagaggccattatcaataatcgtttcttcattatttatcctccaaatatctttcaattaaatcaataattttagtgtttgaataatttctatcaaataacttttctgccatctttcttgatccaatatgcatcttgtttcttagatttacatctaatattaattttttaattgcttcagctacttgatcagaattctctacactacaattaaatccacaagcatagttatcaattagattacgatactcataattttcctgggtactaactactggtaacccactagcagcataatcagaatgtttatttataatgctttgggcagcaccttttgaaattggatttactgcaatatctgcatttgctaaataagtaatcatttctttataatctttacgtcctaaaaaatctacgtcaactttttttaatttactataatttttaaattcttctaataacggaccatcgcctaatactttaaattttatattattgaaacctgataacattaatttgcttattgcatcaataacaatcttaatattatagctatgtcccaatgtcccaacgtatataagccatatttcgccagctttttttataacttgacaattactatacgtattgtcaaattcttttaaatctgttcccaaataaaccactagtccgttatcttttaaattattttttaatcctcttttaagatatgtatcagaaacagcaataatttcatcagctgctttaaaaatcttattttcagtaatcattaaaggaaaaaaaataatatctgatattacgggaatattcagtactaacttaaaagcttctggccataaatcttgtatatcaataaaaaaagggatattgttttttttacaatattttctagctgtttttcctacatcaagtgatggaatagctacatataccaaatctggtttaggtatagttgcaagatatttagccaaattttttccaaaaacataatgactataaaaacgttttatacacacatttttagaatatcccggctcagataacatcgtatatttataacttaatttttctaaaccaggaatatatttatctctagtctttttatttttatgagaaaaatcagttgttacaatttcaactttataatttcttttgcataacagctctgctaaatatataaatctattatttcccggttcatttggtggttgactaaaatgatcaataattaatatttttttcatactcaattaaccttttttatcataatttcattatatttcatcatataaatattttcttcatacttaccaataacattactattttcttttccttgcaagttattgattatcaattttatatgatttacaccacattcatatgcgtgcggatatccaccaccaaatcttggattcacctcagaaatataatactttccatttacattaaatacatcaatatctatttgagctaaaaaatttgcttcttttacaaacttacttattaatttaaacaattcctgatcaataaaagatacagctttatctgtttctcctgctctcataaccagtttcttttttgtaaaaattgaaattggtttttttgtaatcatatcaatgtaacaatcaacccctaattcctggccatctaaatattcctgaattagtaaatcctgattatttttaataagaatatctaaagtctctttatcctctactttacttatagccatactagcgctacctttataaggttttacaaatactggaaaatctatttttccagtttctaaatctttataaaaatcattaacatcaagatatgatttagcgcaattatagccatgatcttttaaccaattgtacattttccatttatccaatgctaattcacaaacatcataacttgacccaataatcgttacacctagtcctttaaatctttcactatttttagcaagtaaagataattctgggtcaatcagcgataacactgctgttatattttcttttttacaaatatctagaataacctcaagatatcctttatcgaccattttaggaacaatataatattcatctgcttcatataaagcgggtgctataggactacaatctgtagcaattacctttcctaatcctaataaattttctttaaaatattgaattattttatttctagtaccacaacttaaaattaaaatattaatcactatcttatacctaacttagcctttctttcttctgcaaaatttggttcaacacttcttgtatcagttgcaatatctgatttttttaaaactaataaaatagtagtaataattatttttacatctaatataaaattaatgttattaacatattcaacatctttttttaaacgatgatcccaatcgataaaatttcttccattaacctgagcccaccctgttaatcctggcctcacctcatggcgccttttttcttctttactataaaatggtaaataactaattaataaaggtctaggaccaacaatactcatatcacctttaagaatattaaaaagttccggtaactcatcaagacttgttgctcttaacaattttccaaattttgttagtcgtatttcatctggcagtaaattgcctttttcatctctttcatctgtcatcgttctgaatttatacagattgaatatcttttcatctttacccggtctttcctgcttaaacagtaccggactgcctaatttgatccttactaacagcgcaatgatcagatacagccagctaaatacaatcagtgccagtaaagaacagatgatatctatcggtctttttaaatacttttcatatggtccatatgctttatgtctgttttccatcatttccataatccttttatgatattgcagatcctttccagatcttcatcattcatctttgtatcacttggtaaacatactccattagtaaacagcttttctgatgtttgatcgttatctatataatcatgatttttgaataccggctgtaagtgcatcggtttccataccggtcttgattcgatatcattttcttccagcgctaccattatatctattggtcttactttacagttttcatctaactggattgttgacagccagcagttggaatatgatccatacttgtctcttggcatcatcgttagcccttccagatttcctatctctttttgatagtattcatagatatatcttttcttagctatcctttgatccagtaccttcaactgtcctctcccgattccagctacgatattgctcatacgatagttataacctatttccttgtgctcataatgtcttgcctgttctcttgcctgtgttgaccagaataatactttctttgctctttttgcagcatcgtcagtgttgaataacaacatcccgcctcctgatgaggtaatgatcttgtttccattgaatgaaataatgccataatcaccaaaagttcctgtatattgaccatttactgttgttcctaatgattcagcagcatcttcgatcaaaggtacaccatattcatcacaaatttctttgatctctttaatatttgatgctaatccataaagatgaacgacaataacagctttaggcagattatctttatacttttcaaaagctttttttaaagcagcaggcgacatattccatgactcatcactgtcaataaataccggtacagctttttcataagtaataggattagctgaagcactgaaagttaaactctggcaaaatacaagattaccctgtttaatgccaatactttttaaagccatatggatggcagcagtaccgcaggataaagcaactgcagctttagcaccaagcttatctattatttcattttcaaattcattaacatttttaccaagaggagcaatccagttggtatcaaatgcttctttaatatacttctgttcataaccttcatcactcatatgtggtgatgctaaaaatatatgtgacatatttgtcccctccataattaacaatatgtcgcaatcatcaagttaaaatatataacaatttttaataatttccttaaaaagacaataaaaccccagtgcaactatgtaatatttttagttacacttggggttttatgatcattaaaaatctgtaacatgccctagtcaatgattacgtcattataaatgttgttttaaaatcttttgcagatttcaaaagaattatatgataatatgacaaaatttgcaatcaaatatttattattctataataactaaccaaaagtacattacttaaacactttattaatcatctcttgtttagttttcatagttggatgaacatagcgattaagagtaatattaacacttgaatgtcctagtatttcactaatagtacgatcatccatccctgaaactatacacattgatgcaaaagtatgtcttaatgtatgatagttagtatctttaatatctaaatactttaaaatatttttaaagtatttagatagtcttctaggttcaataaattttttattatcaccagttaaaacataatcattatcattatatttaatttcttttaatacatctattaatatattaggtataggaacattacgataagatgattgactcttaggactacttattacaacttttgttttattattatcatcttgaatacttattctttgcatagtatgttttattgataatatctttttttgataatcaatatcttcacctttaagagtacaaacctcaccaattcgtaaaccacaacatatactaaaaagtaatccaatatttatatatttgggattactttttagatatgttatcaatttatatgaatctttttcatctaatactttaattttacttttttccctttttttaggaattattacatcaccaatcataatgttacgataaccataattatacgaatatttaagtatttttttaactatgtatgtaattgtctttaaactactatatgaaagcccctgtttattatttccaccactaatactcattttttctaagaatctattaatattaatttcattaatttttttaatatcataaaaacctaaatatggaattacatataaattaacaatagtttgatacttatgaaaagtctgtggttttatactaggttttattgaatcaagccaaatattagcaatcttttcaacattaacacttttttctactattaaatcatttttctctaaatcaactatctctatttcaggataaatatctgtaaatacagaagtggaaattggtgtcccatctctactatatcctaaaataatttttatttcatattttctcatattatttttcctttcatttattaaaaataaggggagaatctagttataaacaaataaaaaacttattactttcattgttcattagaaaatttccttacatttgtataaatttaatcaatcaaatttatacaaatatatagtggtatacacttgacttataagtttagtaattttatacttttcttaaggaggaagtaattgcctatgaacagaataaatagacttgtttggatagatgttttaaaaggaatagggattttttatgttacattcgcacacctttatcctactttaccaattgagaaacatatctattcttttcatatgtttttatttttctttatatcaggttttctatacaaaaagccttcagataccatttcttttatacaaaaaaaattaaaaaatttaataataccatttttattttggaatatttttgcaactctcatagatatatttatttcacatgattatattaatcctatacaacacatgttaactataaacggttctttatgttggaataggcctatttggtttttattaatactatttttcgttgaaattatttttttgtatatagataaaatatttagtaattataaatatttatttgtaattattgcatttatagctgcctatttcacacaaaacactagtgtattcttaaaactaacattagttccaatcgcttttgtatactattcctttggtaatatatcaaatgcaatatatagcaaaaaaataattagcaaaacacatttaataatgattttagcactattcgtaaacatctatactagtgtaatacttaatagtagaatctcagtcgtttctgcatattttggcaactactatttatgcttaattgcaggcatttcaggaattattttctatttcttgttagcccaaataattacattcaaaccactcgttaaattattggaatatattgggaaaaattcaatgattattatgtgtgctcaatattttcttttttacatatattcttttatatttcataaattttttgacataccaaatatatggtatttgcgaaatacgccaaaagcttttattcttacatgtataacaataatacttatttgcttatgttctgaattcattaaattattaaaatctaaaacaataaatactatcattggaatccgatagtaggaggcttaaaagaacaactttttggaaattattatttagtgtgttaacaaagtaatagatttttcaaattctattactctatttttttatacaaattaatatttttatcaattttattgttagaagagattcttcttatttcaatgtcattaagttaagtatttaatgacatttgaaaagttcgtaaaaaagttcttactcgataatggagaattaaaaagataagattgctaaaaagcaacagtatttattagccttttaagaaatagctttttaacgtttacctaaaaaaataaagaaccgtgaaaaaggttctttattttttatatgtttaactaattcatttgcataaaatctttatttactgcttaatttagtatacctattaacattttcatatatttgcccagtaagaacattaaaataataattgtttgaataaatttattccacaaggtaaaaatataaaaaatagatacaaataaacccaaaatctagatagttagattttgggtttttaatacactattttattttgtgactatgatataaagcttatcattctaatatatgttctattttattcttctatttcatcatagattttctttaaaactttttttaatagtgtagatgaaacattctttgtatatggtatatatttaactccagttttaccattcaatctcatttcatcatcaactgtttgaaaaatttctgatcctttccaatcatcaccaacaaacataatatcaaaattatatttatgaaatgcttctattttatctctgttaatttgtggtacaacttcatctacatatttaattgattcaacaattctttttctttcattatacggaataacaggtcttttatttttataattttccactagctcatcagtacttactgcaactattaagtaatcacactgcttttttgctttttctaaaagatttaaatgcccaacatgaaataaatcatatactccagctgtatatcctactattttcttcatatatcttaatttcctttcataaataaaaatatctatcatgatcttttcataatagatttcatattttttataactgataataaatacttaaattcttctgttctaaaactatataaaaaaataattatattcgaaacaataaaaacaacacaccctaataataaccattgtagtgtattagtaacgacaaaataattactaatatataaacatattcccatattagctaataaaattatcaatttaataaaataatcgataaaatattttataggatttatgcctaatccttttttataaattaaataaggatcaaaccatgcattagttgttaatcttgtaattaccgttccccataaaataccagctattccaattttctttactaaaaatatagaaactataatattttctatagctgatataattggtctatattttccttgtgtaaacaatcccattgtttgtctatagttaaaaggagcaaacaacattcctcctacatatatatttaatgatataataaacactactgacgtatccaaaatgtaatctttaccaatccaacatgatccaataaatgggttaattaatacaaaaatacatacagtaactaccccataaagccaaaaagttgctaaattaatgaccctaaacataaaatattttttttcattatcatcaccagcatttaaatttccaatacttgcagtaagattattaaaaatcgttgataaaaaacctgtaacagatgtcacaattaaattataattagaatacaatcctacagattctagaccaacataggctgacataatcatattatcagtggaatttaatgataaggttccaattttatatagtactaatgctgaaacatttttttgtattttttttagttctgttttttcaattggatgttttgatttttcttttaaaaaaggatataattgatcagttttttttgctacataataattttgtaataatttacttaatatctgaataattagataaataaaataattttcaaataatattaaaataataatttgtaaaactgcaacaattatagaaacaattgaatttactctatttataatatgattcttttgagtagcagtcaaaaaagtacttttgtatacaaataaatatgaaaatgcagaatcacaaacatacataacatatattattcttatatatggaacactattaatatcttttattaaatatggcagtaatgggattaacgctaaccccaaaccaagaactatcaaaaataatattctatatatttttttataaagatccatcaatacatgaattttttcattgtcattttcagcaattggcttatacagactaaaaataattgcttgtccaatacctagttcagcaaaagacaatattgaaagtatatttccaaataatccacttacacctaaatatgttgatccaagtgttttaataaaaactgtcctaacaataaaaccagttagcagtataatcatttgcccaattaatcctgtacctatgttttttaaagaattttttactctcataatattaactcctttaatccaaaagcaaatctacaattgattgacaactcttcccattttcaaacgaattaatttttgaaagaaatttatttaaattatttatatattctgtttcatcataattttctatctcatcaaataattgtttttgattttcagcaataagaaatggaagttcactgatattaaaataaagtgagcgattatttgataaataatcctgtaaatcattaacgtataaagcacattttttatgcaaatacattgcatcaaacatacaagaagaataatctgtaataagaaaatcagaaacaattaataattcctgtatatcatcaaaatatgatgcatttatacagcaatttggtaaatcaatgtttttactgatattaattaagttcggatgtaatctatataatactttccattttcctccaaactttttagataaattattacataacaattcataatttaaatcatatgcacttaaatcattattatttctaaaagtaggtgcataaagcaaataattgtatttagaatccaaattattcttatttaataattttagtctatttagttctgtattattttttaataaataatctattcttggagttcccacctccaagattttaccatcataccaaaatgaatttttaaaagtgttactacttaaaccgcatccagagataatataatctatcttctttgaatcctgttttgcattttcgacatacttatagtcaagttgatctgctacatcaccttcaattttttttaatctaattgaactatgccatgtttgtatatatatttgacatttcctcttttcaaatctaaaatgcttaggaattcttgcatttgagataatataatgagaagttaaaatttcataaagatatttaattgaaaaataatttactttacgacaccctttaggtaattcatgcttaatattaacattttcatcaaatacccataccatatcaaatttgtccttatagttctctgctataaattcacacaagtatttaggattacaagtatatgagttacctaaattacttataaaaaatattttattttcttttattggcaaatgtttaaaaagatagatatatatatttattcttatttttttaataaattcaatcatcctaaacccccttaaattaactatatattattcaaataatccaaatcatcaaaatatttttgtagtaattcagtttcatctccttccaacatttcaagttcaggcacacaaatagagccattgatcttatcgtgtgaaaaacaaatcaaacatttattctctatatccataaattcttccatatcttgtttcgtaaatccttctctttgtgaaactttaaatataagactatcgtaatttattcttttacatcttctataccatttttcttttgcctctttttcagttttataatgcataaaataaatttcaatatcatctaatcttgctattggatattctctatctccttttattaaatcataatttttagattcagaaaaactgataaactttaaatcttgattaacataatatttcaattttttacaaaactttatataatcattaccaataaaaaaaagacctatagtaggtgtcttatattgtaatccatatttttgatatataaaccctgcccaacaattatttgaaatgatagtaaaatctttattccttaatttttttcttcgtaatgaacatctaatataattttgaactttcttaaatccattatttattttcgttataacatacattttactctatatttcctttttattttctttaaattttctaatataataatataatgtaattaaattaatatttattctacataagagttcaataattttatactttccacttacctcaatattatttgtttttaataattgttttaacctattttttaatattttacattctttattgtaaccatctttacgtgcattacagtacatatttaatattgtcatataatatcttgcaaattccttatttaaaagatgttcagaatttatctttctcaaatattctattctatattctataggaataaatacatccatttttttaggcataaaacttgaattgataatactaccctggcgcgtaacataatagtataaaatcttatccaaatatatacaggaattaatttttgataaaatatcagtaatcatatactcatcttcatgcaatattccgtttttaaatcttaagttattgaataattcctttttgtataattttgtacatgcagaagctgcccctccacctatctcataaagattttcaaaaaactctatcctgctataacttattttatactgattagaactattatctatttttacctgttcattttcttgaacttccttataattaaattgaattaaatctggattaattttagaatcttcccaaatattaattaatgtatctactgtattaagatctatataatcatcaccatcaacaaaaagtataaacttccctttagcaatatctaacccagcattccgagcagaagataatcctccgttttttttatgaataacaataactctattatctatatctgcaattaaatcacacttatttgcacttccatcagttgatccatcatctattaaaataatttcaatattcttatatgtttgatgtaacaaactttccatgcataaatccatataatcatttacgttatatattggtacaataatacttactaaattattcatcatttatagtgttctcctaaattcaatgttagttacctcctataatattatgaaaaaacaattttaatcttgttatattggaaatcatttttaaactactagcataactataagctacttttttttcatcttgactaattttagagttactaatacaacgaataaaagctgattcaataacatttcttaattgaacatcgtcaaaaaagcaatattttttattcttctctattatttttttcaatatattaataaacaccttaatcttttcaatatcaaattgattaaattcattcaaacaatagaacataaaaatttctttttcattatattcaagattcaattttataagttgcatgcgttcatccaataaattgaaaagtcgctttcttgtttcattattaatattttgagtaatttgttgaggatgaattctataataatgtaaacactcagataacgatgttatttcacctaccattgctattttgcaccacattgcaaaatcttccataccaagatatttattttcatagtaaatattatttttatctaaaatctcttttcttatcattacagttggatgagctacacaaggagaaaatagtaattctgcctttgattttctataatcagttgtaaagatccttttattttcttgaacattttcaccaaaaagtattaaaccagtccctaaaacagaaatatgttgattattttccatgtattgtaactgtttttcaaatcttgttggtaacgatatatcgtcagcatccattcttgctatatattgtcctttagcatgtcttaaaccattatttagactgacaactatacctgaattttctttattttttaaatatataattctgggatcatcataacttaaaattatatcctctgttctatcaatagatccatcatttataataataaattcaaaatccttataagtttgatttaaaatactttctatagcttcaccaatatatttttcagcattatatgctggcattaaaacactaatttttttcaataataaccctcctcatattaaatacttctatttagaactttaacaaatgattttattctcctagaaatactaggaaaataaaatcatttgttttaaaacttaaaatacattccacaaaaaataataccagatataattcatattaatagtaaaaaataaatcgttcattattaatagcaaaaaatattattaaattttattttccattttttttatttaaaataattgctacaatacatagcaataatattcttttttttataattaattttgcccttaaatcacttaaatttaatttatctatttcatttcgtaaaatatgattatcacaaatttttttaatagatcgatatctttcgatatagtttaactgagaggctttataaaattcattattgatagcagcataacataaaccaacagtctgcaactcatatccattaataatactttcatcattattccagcacacctgaattgcctccataattttccctcttgcattcattacaatatcaatcatattgttataatatttatttactgcactacccatccgaatatatctattataataaactgttttatcataaaatattttcttactatatccaattgcatataagttaaaaatacgatcttcagaaaatttcaaatcatcaggaaaataaatatcattttcttgcaacaattttcgtttatatagacctctccaaactgatccagccatttgtactaataatgatgaatcaatcttatctttagttattaatctactcttttctaatagagtaaaactatctgtttcactttgcttatcatcataaactgttacagcatcacagaaaacaatatcaacatcataatctttaatatacttgtacatattctgatacatatttgattctatccaatcatcactatcaataaaacctatatacttaccttttgcttttcttatacctatgtttcttgcaatactaacaccctcgttttttttatggataacacttattctatcatcctttttagcaaactcgtcgcataaatcttttgattcatctgttgacccatcatcaattagtattatttcaatctcttccaatgtctgatttaaaagagaattaatacatttctttagatatattcccgtattatatatgggaacaataatactaattttataatttatttccatgattatttttctcctttaaatatctaactcgacctagcattattcctaatgctacatacggaatcaaatttggctgagtcgctatcaatccaagttctacagattgctgtaggtatataaataaaaatgctgttaaagcagcgcagacataactatcattaaaataatatttagctctatcaataatacttttgaatagagcaatccaagcagtatatcctattattccataagctgttaaacaagttattgccgaattgtgccaactattcccaatttttttagtaccaaataacaagtgttgtttcaattgatcaactccactttcccataaaacatctcttccattaaaaataggtttttcaaactgtttaatactccatgaatttagtctttcataataacttgtattagaaattattaaaacaaaaataattactaataagggtataaataataaatatacgtattttccagtttcataaaagttttgaggtcttataatattgaaaataaacaatattgaaagtgctacaaataaattactagatcttgaattagtaatattcaacaaatatagatataacataactatcactaacgtaaatattcgacggtatttcttctgatcatccatgaaaccaatataaaaaattgtatagctaaaaaaacctatcattgcaattgaattttcattccagcctgataatatagaagtatagttatatatgtataaaaaaagaattcctagtataccattaagtaatgcaattaatttaatatttttatgttttaaaggaaccattgaaaataaatagcatactaaaaatgctgataaatatccaataccatcagtattttttgatagtaatggaataacaatgaaagataaaaataaaacaaataatatgtataaatagtttttctttatatacaatttatctttttttattattattaaaataataggtagcaaaataataaataacaatatatgaaatttaccagtaatattaactgaattacccaatccagatccctgaaccaatgaaataatccataataaaatagaaaaaacagttataagtatcgtgttcatctactcctcctaattaatataaatcataatatattcaattttatatccacctataatgaatataaaagacaatacctaataaaaatgtcattttaactaaaaatttattttctccattatatactagatttggatcattattttttgacaaaaacttaaaagcatgatatttacctgatataataatttttgaaatcaaattattctgtaaatctagcctttgtttaaaatacatacaatatcctgaaggattattcttcatcaattgaatttgcatatttgtatatccatccgattgatattcacaaattgttatgacttcttttaataaaataaaatcatataatatatttatttgatcatatattacacattctcctacaaatttttcattatcaaaaactggaaatggatatttttttgcaatttgtgtaaataaaataatagaaaactctcctctacacccatatcttgcatctaattcatacaattttactctatcaatcttcaaaggaaacttatcactcaacaaattattttctttatcaattttatatgctaaaaaaccacatgtagatgtaataacttctctgcttaaattattaaaacatttttttattttctcaactgcattactaggtaaataatcatctgagtccaaacaaaaaaacaactttcctctagcattttctaatgctaaattataagcagtgtgtttgccaccatttttcttctttatgtatcttattggaaatgatgaactatgaaaaaaattcataaccacactttcagtattatcacttgatccatcatcaataattaaccattcaaaatcaaaacagctctgtttttctaaactgttaaaaatgtcatttaataattttgctctattgtatgttggtgtaaaaatagtcaacatcattttacaaaacctattcctttttctaattcactaatcatttgtttcttttttttatcatctacgttttttcttaaagtatattcttctccaaaacaaggcctttttttcattaaaattttatttttagtcatataattatcataagtacaaataaactttgctggattacctgcccaaacttcattatttggaatatctttagttacggtggaatttgctccaataattacattatttccaatctttaaattaggaagtataacactttctgctccaatgaatacattatttcctataattacttttcctatctttgcatatccaagttcataacaagtactagcatcatgtgctaaaatatgaactctaggagcaattgtcacattatctccaatttttatcaaccaacaatgagaaggatcaagaataacaccatgtaaccttttaaaattttttccaatagttaatcccatagattctaactgttctgttgtatattctccacgaatcctatataatatttttttcatatacttttttacaaaactcattttattctcctatatttgtcataaatttttatagctatatttttaccaagacatttaattattatcttttttaaatatttttttattctaactttatatggcatccaactcacataaaaataatgtacacaaaaactattagccgaattattattgatacaatttatataatcatatggtgaaaaatattcatttggaaaaacttcgatatcatttgttaaaatttgatatttgttattagatttcaatccatatttctctaataattcggttaatattttaacatttgttaaaatattcaaacttccatcttttaaataaaaagaactatctttatatttagctagaaatttcttaaaaataaaatgatgtggctcagcagccataaaactagtagctatataatttccactttcaaaaccaaaaatacattttttttctaataactcatcgaaagatttaaatacttcgacatctgtatccaaataaaaacctccatatttctctaaaacataggctcttacataatcacttacaaatgcatatttttttgcttcatatgcttctttggaataatcattattagaaatatcaaaattatcttcattccactcaataatttcataatctttcaaatatttttcccagctcttaagacatttttttacctcttttggtttatcatttcttccaaaccagcaataatgtataattttgggtatcaaagttattcctcccttttatttttatcaagatttcatttttttcttatgcataaattcatataaaaagttaggcaacaatccaacaatcaatggttttaagaccagtacatagttaaaaaaattcagtttaaaatttttaactattaaatattttacataagcttcattgattctatatttgtattttcttcttcttgctgcatttctatcatctctcattttatacaatggttcttctatgttatatcccttaaaaccttttaaatacatcttgtaccataaatgataatcttctacccttaataatttttttccttctgaataaccaccaacagccttataagcttctattctaaccatacatggtgcatgacaaaaaggtgtgcctttaataaaatcagttttttgtggttccctcaaggcattacttttcccccaatcccctgtttcatcaaaataaatcatattagtacttacaattgcatattcagaattattttctaaaaaattaatttctttttctaatcttgtaggtaatgaaatatcatctccatccatcctagcaacatactttgtatccacaaattttaaacaatgatttagtgtataatttaatcccttattttcattattgcttataagaataatattcccatacttatctgcatacttttttgcaactagatatgtattatcactcgaagcatcatcacacataatgagtttccaatctttataagtttgattcagtaaagactgtattgcttcatctaaagtagaagcacaattataaatacccataataatcgaaatcttatacttcataattattttctccttctacttttatttaaatatttgataaaaagattctctcgatccatttttatgtaattaaaaagagtttgttgctcaaaattatttgttacaaactccacaccattttttccatattcaatacataatttttcattatttaataattttatcatagctttttctaatgtctcaacatccgctttctttacaattaatcctgttatattttttttcatagcatcaattggaccaggtatatcagtaactataacaggtacccccattgcttcagcttctataacagacattccaaaaccctctctataactagctaaaacaaaacagttcatagctgaaaggtattgctcaacgatatttgttcttccacaatatattatttgctcacattcttttgaccaattatacaaatctgaattaactgtcttatcaacttcttcattacctatcaaaatcaaataaatatttctattttttgaaaatattttcttacttgcctctaacaattcatttatacctttatctctagttattcttccaacaaaaccaaatacaaatgcattacttggaatctttaactctgttctaatctttaaattatattctgctttttttgaataattaaacttatttaaatcaataccacaagcactaccattccaaataaccgatcctttatcaataggatagagtttctcatcatgcgcaaaatttaagtttgaataactgtctggctcaatccatgtagataacgtacatactaatttctcttctagtttaaaaatttttcgttttattccattaaatccaacaaataccatcccccattgacaatatagccgaattggaattttggctaaaaaaccagctaaagatgcatataaagaagcattaggtgtagaatattggataagatcaaatttctcttttttaaatatttctctcatttgcatgatagtttttaatccagaaaaacttatacctcttttcattggaactggataataatgtatataatcaggtaattttttcttaaattcttcactataatcacatatgaatgaaatatcccaatcagtgttattatgtaaataaattgctgtttttaatataaaaccttctattgttcctggaatggtagtaataaaacatatttttttcattgcaacaccctaaccttttttaatttattaattgatataatattctgataatcatttcatttttttatcaatacatctaaatatttcatcatataaattttttcatcataatttcctaactcagatttattacaattccccatcatatttttaatcatatatttaggaaaattacacccacattcatatgcatgaggatatcctccaccaaatctaggatttacttctgaaatataaaagttcccatctttttcaaaaacatcaatatcaatttgcccaacaaatcctacttgttttacaaaactgataatcatttgaaacaattcatcatttttaactgaaacagctttgtctgtttctcccgcacgcattaataattttttcttaataaaaattgatataatttctttcgaaatcatatcaacatatacatcaacaccatattcatttccactcatgtattcttgaatcattaaattattatattttttcatattaaattgtaaatctgacatattatctattttttgaatatttatactgcaacttccattatatggtttcacaaaaacaggaaaattgattatatgattattataatcattttcaaattcattaatatttatataacttctcacagttggtatattcaaacttttgcaaattttaaacattttatatttatcaaaacacatttctactattttatattctgatataaatggaatgacaccaatgtcataaaactcttgtttatgtttagcaattaaagataattctggatcaattaatgaaaacattccatttattttttcatcaatgcaaatattttttataatatctaaatattttggatcatcaatacgtggtacaatataatatttatcagcaatatacaaagtaggtgctaatggattacaatcagttacaataactttaccatttccattaagttcttttttataatattcaactaacttatttcttgtaccagcgcttaaaattaatatattcacctttaaatcacctctctttgaatagattttatatctttttattattctttcattacctaaaagttattctcagattagaaagtttattacattttatttacaaagatcaaaaaaatactttaatataatttcaaaaaataatttggatattataatattatttacatacatcatatccaattaaactatctcataattcttccaagtcattaaaaaaaagaggtgtccctccagtatgaataaaaagaatctttttatctttgatattattttttgttaaatattctttcattccataaaatgcttttccagtatatgtagaatctaatggtaatccataatacaataaaacttcttttatcaaatttttaatacagatatttttagatccgtatttatcaaatgtataatcatctaaaaaaatagtcgcattttctatttcatcatctgaaaaatttttatcaataaaattaaaataatcttttatgctgtctataacaacatttcttccatatggattctttcttgctatactaatacctataattttacattcagaattatacaatagttttccacatataagaccagcttgtgtagtccccgttcctgatgcaaagaaaatataatcaaataaaagattgtttttttcttcatatttatttatttcttcataacaatctaaatatgcttgagtcccaatatttccatgtcctccgcctgcaataaaataaggattataattattctgttttaataattttagttgcttttcaattgtttcatgaacattttcaactggaactattgttatttttgcaccatatagattcatcaatttactattaaatgtatcctcagaagactcttttggactaataatatagcatggtatttctcttgaagcagccatatttgaaattattctacaatgatttgaactactactgccatatgttactacacaatcatatccctttgaatctatttcatcaaaaaaaagttttgcctttctggctttatttccgccaaaagaaaatggaatataatcttcacgtttaatatataagttattatttaaatattttcctaaaaattgtattggtgtattttcataatctttatcactcatagatatattaaataaatctttagtgattccataaacataacggtctactaatctatcattaaaatatatatcatttaacagcaaaccttcttttttaaatcctactttctcaaataaacgttgtgcaataatattatctttttctgtatatagataaattctatttaacttaatttcatcaaatgcatatttcaacaataaatatgaagcctttgttgcaatcccttttcctttgaacgaagtgtcccccattgcaatataatattcagcttttttattttgcaaatcaatagttagtaatccaattaaccccactggtattccattatactcaataacagcgtcaaaacgatcgtttctatctttgttttttaaataccattgttttgtcttttcatactctaatggaagatcataatgaagaaattggttattcgcgggattatttatccaattgactttattaattatatctttttcctcaaattttctgagaaatatactcattataattcaccacctatctatttgcgtaaatattgtctcttttaatcacaccaattatcgtttttaataaaattttcaaatcatttcttaaagtaatatttttaatatatgataaatcatactctattctctcatcccatgttgctgaatttcttactttcacttgtgccagtccagataaccctggtcttacatcaaaacgatgtttctttatttcatcatactcgcctacattatatggatggtaagttactggaggtcgtggtccaataattgacatatcgccttttaaaatattaaataattgaggtaactcatccaatgaagtctttctaagaattttccctgccttggttattctaggatcatcattctctttcacttttaatccatcaccaatatgttcagcattgacaaccatggtcctaaactttataattttaaaaactttctgattaagtccgactctttcctgaagaaaaaagataggaccttttgaacctaattttataaatatagaaattatcaataatattggactcaaaataacaattgccaataatgataatataaaatcaaaaaatctcttaaaaaataatttatacattatttccacaatccttttataatattgcagatcctttccagatcttcatcattcatctttgtatcacttggtaaacatattccattattaaacagcttttctgatatctgatcgttgtctatataatcatgatccttgaataccggctgtaagtgcatcggtttccataccggtcttgattcgatatcattttcttccagcgctaccattatatctattggtcttactttacagtttttatctaactggattgttgataaccagcagttggaatatgatccatacttgtctcttggcatcatcgttagcccttccagatttcctatctctttttgatagtattcatagatatatcttttcttagctatcctttgatccagtaccttcaactgccctctcccgattccagctacgatattactcatacgatagttataacctatttccttatgctcataatgtcttgcctgttcccttgcctgcgttgaccagaataatactttctttgctctttcagcagcatcttcagtgttgaataacaacatcccgcctcctgatgaggtaatgatcttgtttccattaaatgaaatgatgccataatcaccaaaagttcctgtatactgaccatttactgtcgttcctaatgattcagcagcatcttcgatcaaaggtacaccatattcatcacagatttctttgatttctttaatattagctgctaatccataaagatgaacgacaataacagctttaggcagattatctttatatttctctaatccttttcttaaagctgtagatgacatattccagtattcatcactatcgatgaatactggagtagcattttcataagtaataggattagcagaagcactaaatgttaaactttgacaaaatacaatatcatcttgttttattcctaatgatttaatagccatatgaatagcagctgtaccacaggataatgctacagcagctttagcaccaagcttatccttcatttcattttcaaattcattaacatttttaccaagaggagcaatccagttggtatcaaatgcttctttaatatacttctgttcgtaaccttcatcactcatatgtggtgatgctaaaaatatatgcgacatataattcctcccctttttcataatcttttttaaactttttctttagactttacttctggtacttttcttttaaatggttttttatatgtataagttggtaccagctcctgaataaatggtctgatattgtcaacttccttatatgcttcttcttttagatctactaatctttcaaagaaactttcttcatccatctcaattggtttcccaatatgaatcagattgttcggtgtctcttgtagtccctcttctttcattaacagctcttcatacagtttctcccctgggcgcagtcccgtatactcgatctttatatctacatctggttcaaatcctgacagcttgatcagattccttgccatgtctgctatctttactggttttcccatatctaagataaatatctcgccaccttttgcatatgcccctgcctgtagtactagtgacactgcttctggtatcgtcatgaaatatctgatgatatccggatgggttaccgttactggtccacctgctttgatctgttttttaaacagcggtattactgatccatttgatcccaagacatttccaaatcttactgcgacaaactctgtctttgatttcttgttgaatgactgcacgatcatctcacagatccttttggtcgctcccatgacattcgttggatttacggctttatctgtcgaaataaggataaatcgtttcgttccatacttgtcagccactctagcggtattcaaggttccaaagacattattctttaccgcttcaattggtgaatcttccatcagtggtacatgtttatgtgctgcggcatgataaacgatctcaggatggaatctttcaaacagactttccatacgtttggtatttcttaccgatgcaatcattacttctagatttaattttggatatttatcttttagttctaattgaatatcataggcattgttttcataaatatcgacgatgatcagctgttttggtttgttggctgctatttgtctacagagctcacttccaatcgatccaccaccgcccgttaccatgatcactttatctgttacatatcccatgatatcttctaaattgacttcgatcggatcacgtcctaataagtcctgaacttcgacttccttaaagtcactgatatggatatcgccatttagtaactgatagattcctggtaatcttttgatcttgcattttgtttctttacaaatatttaatatctttgccaattcttttttatcagctgaaggtattgctaccaggatctcttcaatctcatatttttcagctgcttcaatgatcttatctctaccgccataaataattgcaccatgaacatttcgtccctgttttgaacgatcgtcatcaataaagcacattacctgtttatagacttcctgagaattgatgatctcacgatataccttttcaccagcgagaccggcaccgatgatcataactttttctaaatcttttctttccttaacactgccaaagccaatcttgcttctttttaatctagctagacgataagtaaaacgattaccgcctaaaaacattgttaaaagaagaaaataaataaagtaacagcttcgaggcaaattattaccggtaatttcaagaatacacacattaatgatactgtcagcaaaagtcgccaacacaatatttttaagttcgataattgaggcaaactgccataagctgtgatacagtttaaaatagaaaaagactactagaccgcaagcaatcattggtaaaagcatcactgttagattttctaaatactgattaggtattgggccattaaatctaagcagcatagcaccatatcctgataaagcgatacataatgaatctaccagtatcaagataattcttctaaaatttattttttgtctataattaaaaatatttatcccctccatatcaaaaaaatgtttttttgcaattatgcagttatatataaaaaagaatatagttccccctaccccaagaaagaaactatattcaaatcactaaatgtgcggtaaaccagctacacctatttaattttgcatttaatatttaaacccactaagatttgtctattcataaactcgatatccaagtaagctaatttattgtgtttatcaacttttacaatgtgatcctgataataaattaatgggccttctataactttagctcgcttatcttcaataaatgcttgggacatttctaagatacctttagtatttaaaagtttattaaacatttcaatctcttcatctcttaaagctgatacaccatcttctttaagctgtttaatcaaaccgtctttttgctcacctagtttatataaaaaattatcaaaatcactctgattcatctcacttttaacaaaaatataaccgggaaacaaaggctttagagcattacctttaatgtctctacgataatattctatttgaggaataaatgcatttatcccttttttagtcaaaagcgaacacaacttatcactttttgcaactaatacaaataatacataccaattttctttagtaatcattttatgacttactagtcacctccaaaggcactttcatgactttaccaaaaacatcacccaaaaaagccaatcttttatgacgattgatttttctaatcaattcttctttaccaactaacggtccttcttgaacaattaatttagagtcaacaataatccccgttgaatgcattattaaatgattttcatttaataatgattctaaaagattcttttcatcattagttaaagctaaaattgtttgtgtatcactttgtaaaatcttcatcgtagaacccaaatctttttcaatttctttaatagtcgcataaaacccttgttcatttaattctgattctataaaaagataattaggaaacattgttacttctaaaaacacctttttcccttccctactcatcaatttttcagttttaggaacaaaagcactcattccaggttgattattaaaataaactattaaatcattaattttgttttcatttacaaaaataacataccaattcatttctttcccccttaaaataaagttagcatttgacttcaaaattgtcttaaattaaagtactctacgaacatatttttttcatagtcacacacgcattttatcattatttgacaaaaaaagatagataaaattgttaaaaagttatttcaaaaaggatatagaataaatatctattaaatatttaatttacacaaaagtcattattgccatttctagtcaattttttggtcaaaaagaaaggagtttgtatatgcctagaagaggagaaaatatctttaaaagaaaagatggtagatgggaagcacgttatgtaaaagaaattacagctgataagcgcaaaaaatacgggagtgtttatgcaagtacttatactcaagtaaaaataaaaaggaatgaagtatgtaagttattgactaaagaaaaaaagattgaaagcattataagtgatgaaacagttggttattatataattaaatggttagaatataataaaattagatttaaaccttcaactcatgtcaaatattataatactatcaataattatttattaccttattttaatgcaatcaagataaaagaccttaatagtaaaactattgaacagtttacaactaaattattagaagaaggaaaaatggggaatccattatcacctaaaacggtaaaagatactttactattatttaaagaaattattaaatatattgaaataagctataacataaatctaaacattcaaataatatatcctaaaattcccaagaaagaaaactatgttctaacaaaagaagaatttataaagttaaataatgtattattagaaaatattgatgattgtaaatttggtgtgttgattgcaatggcaaccggtttaagaatcggagaattatgtgctttgaaatggaaaaatatttatctggatgaaagttatatttttattgaaaaaactatgcagcgtataaaaaatttaagtagtaataatcctaaaacgataataattgaagaatcacctaaaagttcaacttctaatcgtaaaatcccaatccctgagaatcttttgcctttattttataaatttaaaaaagatagtaattgttatttattaactggtcgatcagataaatttattgagccaagattattagaaagaaaattttcaaaatatataaaagcagcaggaattggcaaagcaaactttcatatgttgagacacacttttgccactatgtgcattgaagaaggatttgaaatcaaatgccttagtgaaatcttaggacatagtggttctcaagttactttagatcgttatgttcattcatcatttactttgaaaaaaagctggatcaataaattttcaaatcaaaacatttcttgtcattaattttggtcaattgaaaaaagtgcttattttatagcacttttttaatatgttcgtagagtactttactctaaggctcttattattgttcacattatttacattatttaaacaaaattaaataataatacaataaaaactctattaaacaaaactaacttcagttcaatagagttttttattttaagacatgatttgatatctatcacactcaataaccaaaaaagtaatcacataatatttttgattagcattttatctaatataaccacaaaaaccacaataaatttacttaaatcatcttgaaaaaatagcatataatggtaaaataattcagtcgatataacaatagggggaagaacaatgaaaccatttacaaaaatgaataaaaatgaactattagacttaaaaaaagtattagatcaacgatatcaagacttcaaatcccaaaacttaaaacttgatatgtcacgtggtaaaccttgtaaagagcaattagatttatcaatgtctattttagatatgaaagattattctgttgatggtatagattgtcgtaattatggggtattagaaggattaccatcattacgtaaattatttgctcaattattagaagtaaacgaaaataatgttattattggaggaacatctagtcttactttaatgtatgactatattgctcaagctatgctatttggtgtttgtggcagtaaaccatggtcaaagtatgataaaataaaatttttatgtcctgtccctgggtatgatcgccattttgctttctgcgagttttttggcattgagatggttaatgttccaatgactaaagagggtcctgatattgatataattaatgaattaattaaagatgatcgtgttaaaggaatgttttgtgtcccaaaatactctaatccacaaggaattacttatagtgataaaatcgtcaaagccttagcatctttaaaacctgctgctgatgattttagaattatctatgacaatgcttattgtgttcatgatctaaatgaaccgggagatacacttctaaatatttttgatgaattgccacttcataataatgaagatttagttattatggttgcttctacatcaaaaatcacatttgctggaggaggagtttcttgtcttgtagcaagcgataataatatcttagatataaagaaacgcttattttatcaatcaatttcacaagataaaatgaatcagttacgtcatcttaaattctttaacgatgtagatagtattaaagctcatatgaaaaaacaagctgccattttaaaacctaaatttgattgcgtaataagtcatttaaataacgaattagcaaataaaggaatcgcctcatggcatgaacctaatggtggctatttcatcagtcttgatgttatgcctggttgtgctaaaagagttggtcaattatgtaaagaagctggtgttgttttaaccactattggagcaactttcccatatggaaatgatcctcaagattctaatattagaattgcaccttcttttccaaccattgatgaattatctcaagctgcaacattattatgcatttgtgtgcaaatagcagcaattgaacaactaacaataaataattaaaaaaagagatttcgaacatggttcttactcgcttatgggtaaatgaacttattagacagcacaagaaattgtgctgtttttctttagtttgtatttcttgtttttgggcattttgatacaatatatgtatggatggtgatacatatgaaatataatgaaatcagtttgaatgaaaaaatctttggtaatgacttcattgtctatgactggaaagaatcagataataaaatcataatatatgtgaaagcgacttctcatgatgatgtatgtcctgtgtgtggttctcctacaagttctttacataatacctatcatagaatgattcaggcttatcctgttagaaataaaacaacttttattgatgtgattgcttataaatatgactgtactaatgacaaatgcaatagaaaggttattatgcagaatcttccttttgtttctccctctcaaagaagaacagatgagcttaactgtcttatccttgcagtttctctctttttaagcaatgaaggtgccagtaaagtactgaaacttcttggggtcaatataagcaatgactctatcaaacgcctgactgataagatcattattgaagatgaccctgatgtcgagtctattggaatagatgatgtggcgatgagaaaagaaaaggcttatgcaactgccatatatgatatggaagatcatcatcttattgcgcttttagatggaagagataaggaaacagttgttgaatggctaaaaaatcatcaaaaaataaagattgccacacgtgacagagcaagtgcatacgcttctgcaatcagtgaagttttacctgaatgtatccagattgcagacagatttcatcttcttcaaaatttaattgacagaataaaagatatttttaaaacggaaataccggaaacagtattcataaaagatggaaaggtactggaagaggaacctcaaaaggttccagcattaaaaatcgatccaaattcaaaggaacttgaaaaatatgactatgacaacagtatgccagttgataaagaaggaaatatgattgattttgatgcggtatgttatgataaaaacgataaacaacacagacagcaggctgaaagccgtaaaaaaaacagaaaatgatcattgacattcaaaaaagatgggaggaactcgaaaaaaagaaatacacaacaatagctaaagaattttcaatatcaaatattgtagctaaaaaatatgtaaatatgagtgaagaggatattcaattgttggacagtccaaagaaatacaaacaaagaaaaacagctacagatgactatatcaatatgatctataaaatgatcctggatggaataaagccagaaataatctttagctatgtcattatgaaaggatataaaggtacgtggaagtcattggataacagaattgtatacttattaaaaaataattttagtatttctctttcaatggggtggtatattaagtataaatatccagataatatcatcatcataaaaagaaatgaaatattaaaatacataacaactaaaaatgagaaaacaaagaaaaataaaacagttgaaaaaaacattcaaataatcaaggaaagatatccaattataactgaactagaaaaaatatatgattcgttttacagcacgatcaaggaggcagatactgatcagctagataagtttattgataattatagagaatcagtattaaaaggatttatagaaggtatagaaaaagatattgccccgatcaagaacgcaatatcttatccatatagttcgggatttgttgaaggaaacaacaacaaattcaaactcatcaaacgtattttatatggaagaagcaaaatagtcaatctttttaggaaatgttacataccatttttaatgaataataaagattttaagctaattgatattttagaacacaaaaacagcacaatttcttgtgctgtctaataagttcatttacccataagcgagtaagaacctcgaacatgaaatctctttttcgtatttaccctaagccaaaaagtctctataaaattgttaatataaatacttcttttaataactatcatctatttttcgtttaaacacttcaaaatcagcttcttcaaatatatatttatatattaattctatttgcttttcactcaagccttctacccatttactacaatctttttgatatcttcccttaagtaattcaatacaattattcttgtttcttttaatttcctgtttacggccaatctcaattccctgttcaatcccttgctcgatgccttttttgattccttcttcaattcttttggctgtcttttcttcgcgttccatctctaaggattcagttctaagcttcgctaacgctaactgattcgctaatgaccatatcggctcattacttctaaacttgtcatacatctttatcaccatctccactatatcttcttctctttccttcattatagcagtgtattcattttttataaacaaataacataatctttctagatcatttaatccttcaattcctttttccttgatgatcttatcgatatgtttcatcttgataaaatagcggtaattaagattttctttttccagctctccctgatcatctcgaaacgcataatctttgatcaaacgatcatcatcttcattgataaagatgatttgatatattggtcttagctgatgatatttttcaccggtatcgatctgttctactaacagtctggcaccatagaactgaaagcgggtactttcgctattactattgccagccatctgcatttcgatatcaataattcgacccttttcatcaacagcacagatatcgaggatgatgtttttagcgaggaccgtattttgattgatttcgggatttttaacgatcatctgttgacagtcaagatgagtgacagatttaacgataaactttctcagttttatagattctaaagtatctctggaaagcaggtatttaaagaacaggtcattattaaagcgaacattattattatcgataatagttttttcatgaatcatattttttcctcctcattatcttttacaatctaaaaaggagaattactttaaaaaataataattaatttaattttttattttttcaataaaatcaaataaaagtttttgttctcttcataacatcatgtataaagcattatgtttatagatttataattcctaatcttttgtcattggttttatacaatctttatctaatatatctgttaatactctatttaaatattattaaaaatagtgatatcaatcattgcttctaatagaatttatcttgtttatagtaatatttattataaaaaggtatcaaatttttttagatacctttttcatctttaaattaatttaagaagacaaaatttcccattgtaaacactcattttaacaaatccataaaacatagataaaattatttattttttattctgttttttcgatatttaagaaaatcattaaaaaacattcttattacgcaaattagaggcactcctaaaaacattccaataaatccaaataaactaccaaacactgtaattgaacaaataatccaaaacggtgaaatacctacactatctcctaaaattcgcggtcccaaaatcaagccgtcaaattgctgtaaagcaaagataaatattgctgatgttaaagccggcataaacccttcaattaataaaacaataaaaacaactggtattccgccaataaaaggcccaaaataaggaatcatatttgtaataaaaacaacaaaagctaacaatggaaaaaacggtaatcccattaacccaaaaccaactaaagcaattaatccaataatcaccgagtctataaacttaccatagataaactttccaaaaatattatgtgatttaaatgcatattcatgaattaaatcaagattgtcttttttaataaaagataacataaaacgatcaaatatatttgctaatttatccgcttcaattaaaatatagggacaaaatattaagcccattaaaattgttaataacgtacttccagttttacctgcaaaaataattatttccatataatcactactactaaaactttttaaagaatttacaaaagtacgctcaaattgaataattgtctgcgatgtattaggatcatcgaaagttttattgatagaactttcgaatccttttacatatgtatctatatttttaataaattcaactgcatattccattaccatcggaatcaaccaggtaagaagtaatactactaataatattacaattaaacttactaataaaacactaataattcgttgatatttaacaagaaatctatttttactattaataaacaattttgataccatttgtactaaaggttccaaaaaataagctagaattccaccaattataattggaaagaaagcatttaataaaatagaaaaccatgatgtatcaaacatcttataaattactatcagaataataccaattattaataatccactatattgtttcaatctatttccctgcataataaatctccttaaataactacaataattataccacaattatcactgtattacccttttttattccataactttataaaggccaaatcatgcttaaacatccagcatttatctaaaccacatttatcattatatttctaaaacaaacccttcttatagcattttatgcagcaaagaagggtttattacaaaaatataaaactaaactcatcgataacatcgttccgccaagtacatcactaaaataatgtaccccaagataaatgcggcttaaatcaactgcaacaataattaatactgatattacgattaaaacatgacgaaaagaataattactatgatataaataatatataaccatcccatataagcaactaactgccatcgcatgtccacttggaaaactataatttgtctctaccactaaatgaataacatcaggtctaggtcttttaaaaataaattttaatcccctatttatcaattgttgcaataatgaaagaatcaaacaattaaaagcaatctttttattaaaaaagaaaattaatacaattacaccaataatccccaaaaaactccctaaataagtaattacaataactattttagtaatttctaaactctcaaaactatgaagtccctcatatatcaacaagtctaaaggagcaataaaacccgtttgcatcaaaaaacaatcaattacaaatattaataatggtacccaatacagccatctcttataattctttattaactctaataccattttctttaacaataaatgccggtactcctacaactgtacaattatcaggtacatcagcaagtacaactgtctgtgctcctacaatgctgttattaccaatagttacatctccaataactttagcacctgcagaaaccataacattattcaacaaagtaggatgccgcttaactttatgttcaccagttccaactccacctaatgttaccccttgatataaaacacaatcatcgccaataatagttgtttcaccaatgactactcccataccatgatcaataaataaccttttaccaattgtagctcccggatgaatttcaattcctgtaaaaaatcttgcaatttgacttaaaagtcgtgccagaaattttaaatgcagttttttccacaaaaaactattgattcgataacaaaacattgcatgaaccccaggataattaatgattacatttaaagcatatcttgcagctggatcagtttctaaaactttttttattaaactcttctctctcatattttcactccttctagttaatataactattatttataaatattgcaactaatatattaataatttatgattatatttaacttttatataggtcaaaatatcatacttttataaaatttaatcataaaaataaacagaacccatcccctttggattctgtttaaaaacattagatactattttgttatagtgtgtatctttcttccccttataaatcattaaatgatttataagtagattataatcattaatttttatatgtcaataaaataattgaaataatctaattttttatcatatttttagtatatcgctaaagtttataaaaaaaataacatatttgtatacaattaaatttaatttttacaaaaaatcatatttttactaaaattaattttattaatataactttataacttagcttatttaaatagttgatattgcatttaagacaaatttatgttattttattatggtaaacattaaaggagaatgggtatgtattttgtaataaattgttttattagtgcagtatgcattgtttcattaatactatttactgaagtttttcctaaatggattaaattattaattggagcagttcaagttattactacctcatatgcaatagctattctaatcaaaaaaattggtgaatggacttctatttggtctggagattataagtatattaactctaactttttatggatcttaccaattgtagcagtaataactattttaattgcatacatctgcagcaaaaaagcaaaaaaatcaaagaaaaaatcaaaataaaaacatgaatttaattcatgtttttattttatcctttttctaaactaatctgtctaagtgttttggccattcgctttaaagcatcaacaaccaaattattatctcgatatacacccaaaacaattcttatatgccccataccaccaggaccataatttatcccatcatttactgcaacttttgcttcacttactaaccttttacaaataagcgtactatcacctaatttactaacatctatccaagccaaaaaaccagattctggcaatttcattttaactcctggaatatcatttaatatttcataagcagcatgtcgcctaaaatcataagccttttcaaactcctccataaattctggatgtttaaaagcctcaatcgctgctatttgactaactgtatttgtcgctccaataacacttacagcacaaccatacattacatccataatttcatcacttgcaataatatatccaacacgataaccacttagtcccataccttttgaaatagaacaaactgtaattgtatgttcaaacatatctggtagactcattggggcaataaattcattttcaaaagtaaaatcttcaaatgcctgatcacatacaagaattaaattatattttaaaacgacagtcctaatggcttctaaactttcacgattgtaaatagttgtagtaggattattaggatgagttaatacaatcatttttgttttatcagttatcaatgcttctaaaatctctaaatcaatctgataattattttcatcttttaattctaaaatcatcggtgttgcttgcatcatcttaatattttgcaaattattaggataactaggacatggaatgataacttcatcatctctttgtaaaaatggaaacatcgaaaaaaacaatccactatcacttcctggagtgatgattatattacgatcaggcttcaattccaccccatatttttctttcatccttttacaaattatctctctaagctccatatttcccgtaggagctgtataatgactagaaacaggcgaatgtatagcttcgattgtttttctcattattggctcaggaatagaaaaatcaggcataaaaggatctgcccatcccattaatgccaccccattttcagccatcttagcataactatcaccaacatccgctttttctacttcactaaataatccgccttcaaagtttaaaaactcttttttcattttacttttcatattctacctactttataaaatatatattctttcgaccgggatataaataaatcaatccttctttagtaaatgctacagtttcttcagtatagaaataatattcctgtccaaatactgttgcctttgtattcaattccaaagcatatgttgtatcatatgatattaaaacgtcaccttttacaggaatctcattttgattattccataaaccaatagttggtccaggtccatgaccgtaaatattacatggatgtgaatataaagtagccacaattccttcaatctcagcctgctttaaagcctcttttaaaacctcattaccacttttattttcagccatacaatcagctacaatatcttgaaaacgattattaattttcattcccttcactatatcatcaggtaaacgatcttcatcatctctagcaatataagctaacctttgcgtgtcagtacaaatatttaaatatttaattccaaaatcacaatgaagcaagtcgcccttttcaataacgccaaaatatctaggatcatttaaaccaggtctttgcaaatcaacagtaggctcaaaccaataatccaatcccaaatctttaaccatttgcatcattagccattgtaaatcttcacaagtcgtaataccaggaataatattatctttactaaaagctgtctcaataattgaaaatgctacttccattacctcaggatgaagctttaattctgtcggagttcttaattccattaatttaattgccaacatgtcattgcgaacgatccgctcaacatactttttatccattttacttgttatcatttcatataatccctgtgttaatccatcactaaatgaaaaattatcagagacattaacagcaatactttgtgggtcaaattctttgcataaacgatttaaacaggccatttgatcttcatgattaaaatctgtccaataacttacataataaggtgctaactctacactaggcatacataatgaaaaacaatgaatatcatcattatcttttacaaatgcaaatagtgaaattcgtctagctgtgggataattagcaggagtaattgcatgaaacaagggatcctcattatactcttttgaagcactgatccacatatcaacattattttctttcattacttgtggtaaaataatatctaaacgttcttttaaacaaacatctttaatctcatattgttcttttatcgatcttattttaatcattattttcctcctattaaaataaggtacattttagatgtaccttatttgttaaatgttattctgcaattttagcgtaagctaattgataatgaccttcaggtgaatgagtaactccagttactttagatgataataaatatggttcagtatatccaagtaatggaacgatataatgttgttcaccaactaaatagttttcagcttcgtgtaaaccattcatacgttcagttacatcatcaagtgcattagcagcatttaccatactttcaaatgtagcatcatcaacagtatttcctaaagtagtcttaccaacatacattgataaataagccattggatcaatgaaatcagcagtcatagcatggcgacaaagttcaaaatcacctttatcacgttcatcaaagaaagcttctttttcagttgcaactaattcaagattaatataagcttctttcatagatgcttgtaatgcttgagcaacatttttatgcatcgtattgtcgttatatttatatgttagatctaacatattatctttactatatcctttagattccataattgctttagcttcatctaaattgtattcagctaattttttaacttcatcttgttcttcacggaagtcaccagttgctcctggaattcctttaggaactaacccgcttaattcatatgcattgtcaccataacctaatgcttgtaaaacgttatcacgatttacagataaaccgattgcattacggatatctttatcttttaatgcttcatttgtattttcatcaccagcattgattaatatatagtagttacatacaaatggatcaattttccatgattgttcacttaattcttctttgctcttaattgtatcgatgttacaagaagtcgcaaaatcaatttccccactttcgaatgcactagtttgagcatccatatcagccattactttaaatgaaatagaattaatagatactttatcagcatcatagaattcttcattcttttctaagataacttcatctttagtgtttacagaagtaactttaaatgctccattataaggaacgtcgctcttatttccccaagatgaatcagttaaatcaccatctttagcgttatcttttaaataatcttctctaactggataaaatactgtgttagttaataaagaagtaaagtaagcacatttagcttttaatttaatttcaatagtagtatcatccaatgcttttgcaccaaaatcttttaattcatccatagtagtatatggtgtatcgatttctacaccagtcttttcatctgctaccatgtgagaagtaccttcgatatattgccagataaattgtgtgtaatatccttgagttggaactgcacgtttccaagcatatacgaagtctgaagcttttacagtttcgccgtcgctccatttagtgccttctttaattttaattgtgtaagttaaaccatcttcactgatttcaggcatatcagtagctaaatttggaataacattaccatcagtatcaagtgcatataacccttgataaacttgtgttaagatgttagctgtgattgaatcatctacgattgcaggatctaaatctgcagtatccccaccaacagcaactcttaaatcagcttggtttccaccaccacaacctgttaaacaagttaaagccattaagaaacaaagaccataagttaatagttttttcatgttttttcccctttcaactatttttcatataagaaacatgctacttgacgatcaccaatatttttcaatgttggtttttcttttgcacatctctcagttgcctttggacagcgtgtcctgaatacgcatccactaggcggatttatcggacttggaagttcaccttccaatacgatacgttttttagaacgggcagtatctggatccggaattggaaccgaagataataatgcctgcgtatatgggtgtaacggctcatgataaacatcatcagcattcccaacttcaacaatatttcctaaatacattactccaattcgatctgaaatatgtttaaccatactcaaatcatgagcaatgaacaaataagcaattcccatttctgcttgaattttttcaagcaggtttataacttgagcttgaatcgaaacgtcaagagctgagattggttcatcacaaacaataaacttaggatttaaagctaatgttcttgcaatcccaattctttgtctttgtccaccagaaaattcatgtggataacgtcgaatgtgatctggttttaatccaacgatttctaacaattcacgtactcttttttcacgctcttcttttgtatcgtaaattccatgaatatccattggttcacgaataatttccccaacagtcattcttggattcaaacttgcataaggatcttgaaaaatcatttgcatatcacgacggaactcttttaattttgctccctttatttttgtgatatcttcaccttcaaatataactttaccagctgtaggttcataaattttaactaaagctctacccgttgtacttttcccacatcctgattcgcctactaaaccaaatgtctcacctttagcaatttcaaagtcaacgccgtcaacggccttaacgatttgctttttagctaagaaaccacctgaaaccgggaaatgtactttaagcccttttacttttaaaattggttcactcattttctattcccctttctttaaaactataggatttccaagccagcatgaacaaatatgagttttagaatattctcgatattcatccattttaagcgggcagatattcatcgcatcctcacaacgatccacaaatggacatccatcagaaatattcaataaatctggtggtgacccaggaatcggatgcagttcttttctttcagtatcctctggatttgcgatacatgataataatccttttgtataaggatgctttggactatagaagatttcatctgtagtccccatttcaacaattttaccaccatacataattgcaattcgatcacatatactagcaacaactccaagatcatgagtaatcatgatgatcccagaatcgatttcatcttttaaaccactaatcaagtctaacacctgagcctgaatagttacgtctaatgctgtcgttggttcgtcagcaataataatttttggatcacaagctaaagcaatagcaataattattctttgtctcatcccccctgaaaattgatgaggatattgacgaatacgactttctggtgaaggaattcctacctttttcattaagtcgattgctttactgcgagcatctgctttagatattcctggattatgatttataatcggctcaattaattgagtttcaattttaagcgttggatttaagaaagtcattggatcttgaaaaatcatcgccatatcatttccacgaatatcatccatcgtagcttcgtactttttattagaatcaaaacttaatggtgaaatttctttaccatcaattttaattgaacctttagttactttaccattagcagcaagtaatcccataatagagaacatcgtctgtgattttccagaacctgattctccaacaattcctaatacttcacccttatctacataaaatgacacatctcttacagcttttactgtcccattttcagtactaaattcagtagtaaggtcattaacttctaacattttcattttataactcccctcctacttcttcttagggtcaagggcatcccctaaaccatcaccaataaagtttaaagctaacattgttaaacagattgccaaaattggccaaacaacttgtaaaggctgtgaactgatcattgctctggcatcattagctaatgtcccccagcttgcttttggagcagaaagtccaattcctaaaaaacctaatgttgcttcataaaaaattgaactagggactaacattgaaaacgatacgatgatcggtcccatactattaatgatcaaatgttttaataaaatacgtgatttactagcacctaaaacaaaagctgctaaagaaaattcctgttcttttaaagtcatgacttgggctctgacctgtctagccatccccatccatgaagaaatacaaatccccaaaattattgataagaaatttgatcccattacaactgtaatcataatcaaatataacatgtcaggaattgaatacaaggcatcgacgatacgcatcatgaccatatcgacttttccaccgatatatccagcaaccgccccataagtaactccaaccaataaagaaatgatagctgctgaaaaccctactgaaagagaaattctaccaccatacataattctaactaatacatcacgtccaaaacgatctgttcctaaaagatgttccatcgatggaccagcaaaagtattagccatatcttgtccatcataagtatattgagaaaatattggtattaaaatactgcaaattgccattaatgctaagaaacataaccctatcaaagctaatttattagctttaaaacgattccaagcatctgctaaataagtcttactttcatacgaaattttttcactattcttttttgaatcatctaacttctcaaacatatcaggagtaagttcgatgtccataactctattttcttccatcttgctcctccttattttaatttaattcttggatcaactactgctgataaaatatcagtaataatattaaatgtaataactagaaagcctaggaaaatcgttaatcccataatcattgggtaatcacgagtttgaatactagaaaccatctctctaccaattcccggaattgcaaacaacgattcaataacaaagcttcctgtaagcatgtatgcaaacgctggtcccgcatatgtaatgaccggaatcattgcgtttttaagtgcatgtttaattacaacttttttatatgatgttccttttgaacgagctaaaataatatagtcttgtttcatgacctccagcatactgctccgtgttaaacgacatatcattgaaatcggatagaacgctaaagccattactggtaaaacataattagcaggtgtagataatcctacaaacgggaaaagcttcaacttgacccctagaacgatcattaataaaatacctattaaaaaagaaggtactgatacaccaatagttgcaataaacatacaaagattgttcacccatcgatgctttgaaagtgctgctacagttcctaaggctatccctattatcaaagctgtagcaaaagcagtagatcctaatcttgctgtaaccggaaaactttgagtaatcgtatcagaaacttcccgtcctgaacgaaccatactctcacctaaatcgccatggatcaaatctcccatatagatagtgtattgctcaaaaaccggcttatccaaattatactttttaattgccaattctcgctgtgcctgatttttatatttttcaccactgatcggtgaacctggtgttgccttcatcaaaaagaaagtcgctgatgaaagtaaaaacagggttacaattccaataagcacacgttttaaaacatacctaaacatctaatcacctattcctttactttatatacttattaggataccttaaaatgtcccaaatttcaaatacttttttacacacaaagtccgcatttatcaatgactttagcccaaaaaccgctaattgtatacgattatacagatttaaaaaaaaaataaatttttttcttttttttcttaaaatctattaatttcgatgaaaaaaaacaaatatgtattaaaataaatacaatttattcactttcataaatacctcttccagcaagctttgcttcatcatttgcagcaattatttcacttttataagtataatcataaccataatcataaaacttctcaaccagccccgctcgcgccaatttttcctgtaacaactcaccatcaacaaatacccatgcaagcatacgatcatacttatccactgtctcaccatcctcatttagctccagttctatttttttagcattagttaattgagcttgggtataatcactagcctctttaccataaggctctatttgattagtcgattcaggcgtatcgatatacaaaaatcttaccttagtactttcaccatcaatattaaaccatgctgtatcaccatcaacacatttatccaatgttacttcaaaacgcttacctggagaaatagttttatgctcctgataaaaattatatccaaaaattatcaagatcactattattcctaaccatgatttagataatttattacgctgtgcttttgtcattttaatttttttagccatttatacctaccgcctttttagctaatttatctgctctttcattataaacatcaccactatgggctaacactttaacaaaaacaatatccattgattctcgatactggattacctttttttgatattcctgagtttttattttattagctttccatgatccattagcccatttttcaattccctcataatcataataaatacatacttgcatataaccgttgtttttagcaaattccatagcataaaggctgcctaatatttcacctgccacatttcgcattgaagcataattgacatcattgcctttatcatacacttccttgattacctggccgccttcgatcaatacacaaccaaatccgtattctttagttttaacattatagcttccatcaacataagcaatcaatccttgttcaaaagtgacctgcttttcttcgataaacattttagcttcattttcactactaaaagatttatacactgccccgctatatctatcaacttgcattttacattcatcccatgataaataaattcctggttttcgtcctacttttactgcataatattttgccataactactccttatataaaaatatatcctattttaaaccagaaaaaataaatagtaaagagactggttgtctaattaataataatgagtataattaaattattagaactaaaggagatataatatgaatattgaagaaagatttttaaaatatgttagttttgatactcaatcagacgaatattccaatactactccatctactttaaaacaattagagttaggaaaagaattggttaaagaaatgttggaaattggaattgaagatgctcatttagatgaatttggcatcgtttatggaacaattaagggtaatagcaaaaacggtgatgtaataggttttattgcgcacatggatacctctcctgatgctagcggtaaaaacatcaaaccacaaaaaattacaaattacgatggttctatcattgaacttaacaaagatctaaacttatctttagacccaaaagaattccctagtttaaagaaaatgattggtcacgatctaatcactacagatggtactacattgctaggtgctgatgataaagctggagttgcgattattatggatctagctgattatttatctaaacaccctgaaatcaagcataatgacattaaagtagcttttacaccagatgaagaggttggacgtggaaccgataattttgatgtaaaaaaatttaatgctaaatatgcctatacattagatggtggagatattgaagaatataattatgaaaattttaatgcttacagcgctaaagtagaaatcactggtaaatcgattcatccaggcgatgctaaaaacaaaatggtcaatgcagttaatattgccatcgaatttgaaaatatgttacctgctgatcaaaaagcatattatacagatggctatgacggatttaaccatttacatcatttagaaggtaattgtgaaaaagctactttagagtatataattagaaatcatgatctacatttagcaaaaaaacaaattaacgattttaaaagaatcaaaaaatatttagatgataaatatggttatgaactaatcaaactagacatcaaagaatcatatttaaatatggctgaagtaattaaagaaaattattatattattgaaaaattaaaagaagctatgaaaaaagtaggaatcgaaggtcatgctagtccaattagagggggaacagatggagcaagattaacatttatgggattaccatgtccaaatatcggtgctgggggagctaatttccacggtccatttgagtatgtttcacttacaatgatgaaacaagctgtaaaaatattaacagaaatcataaaagtgtaaaattatgaaacgctgtttatttattgtaaacccttcatctggacaacgttctttacaaaataatttagataagttaattggtcaactgatcatcagacaactagtaaatcatgtagatattttttataccgctaaaaaagatgacggttactataaagcattaaaatgcaatgaaaaagattatgattttatcgttgttgtcggaggtgacggtacaatcaatgaagtagtaagtggaatggttgaaagtcataaaactatacctttatgtattttagctgcaggaacagttaatgattttgcaaactatttaaatttaccaactaacattaataatatctgtgatatgatcagcaatttccatactgtctgctgcgatgttggtaaaattgataatcattattttatgaatgtagctgctggtggaatgtttagcgatgtctcttttacagttagtaaagccgataaaaaaagacttggtcctttagcctattaccttagtggattagctaatttaccaagtcaactaaatactaatattaatcttaaaatcatccttgatgatgtaaatgtaattgaggaagaggctaaaatgtttatggttactaacactaatcgagtcggtggttttgaaaacatcattccattagctgatatccaagatggattattagatttaattattattaaaaaatgttctgttaccgatttagttgccctatctaaagattatattttaaaaaaacatgctaatagtccttttattgcatattttcaagctaaaaaaattgaaatatatagtaaacaagaagtattacttgacattgatggtgaacagggctcaccacttccagcaactattcaagttattagtcaagccgttaatattttaattccaatttaaggggtcctcccctttttttatttctttttggctgaaactaacaacatcattggccgcctcatttcatctttcattccaggaagttcaatcatttctggtgatggttgtggtgttgattagcacattatataaacaaaaaaagacaggaacaaatcaaattaaattaataaatataaaaaacagctgaaataatttgataaattaatatgcaaattatctcaactgttttattattatgtttaaggagatcggcatacaaaaaagaaaggatcattggattgcagtcctacctctctttttccccaaaacattatgtatgtcttgtacacatcaatgataacatttaaaacactttctttcaataattattctcaaaactcttatgataatgatgtaagatcattagatcttaataaatttaaatgtacctgcggttctactggacattttcatcgtcatgcctgctatcagcgttatctggctattgattccaaccatacgctgctgatttctatcgttaggatcaaatgcgaaagctgcggttgcacacacgctcttcttcccagtatcattattccctatcgaatattatcaaatccatcgataatcagaataatcaagtcttatcgcaatatcacgcattcatgttccgttatttcaaaaataaccggtttttccagagaaacagtaaaaaaagtcatcaggttttatatccgattccatcagaaaagactcgattcatttttgagtgtttttagagtatctgatttttatgactttgatttcatactgaattacttttacgaatatcacaccatgtttatgcagcgtatttcagtcaacaatatgacaatttatacataaacttattttcccataactgttactttgaatatttcttccggctgttatatgtttaggtcaggaggtgtattttatatgaataacagtaaaaaagatgatctggatactaagatcgcactttttagatatgaactgatagtaccagttcttaacagaacctatccagatcgttcggcgctgcagtattataaaaggatcgcgtccaatccattgaagtatcctgatggtacatcgagagaatattcatttcaaacgatacgatactggtatgatacatatcaaaaagaaggatttagtggactgatgccaaaaacacgcagtgacaaaggacattcaagaaaactgaataaaactttgaaaaacaaaatcatggaaatgaaaaaaacgaatccaaggatgacagcaacttctgtttatttgaagctcattgaggatggagatatattaaagaaagatatctcattatcgaccataacaagattcattggatcaaaaccggaattcaatcatgtcccgatcgaagatatgagagcatttgaaatggagcatagcaacgatatgtggcagctggatactacctactgttcatatatcaaagacagcagaggtcatagatcaagaacctatcttattatgatcatcgatgaccattccagaatgatagttggatatggattcttccttgaagacaacgctgtcaatgtccagacagtactgaaacgggcaatagctaaatatggtgttccaaaaagactgtatgccgataatggaaaaccatacaaaaacgaacagttaccgatcatctgcgctcagctgcagatccagatcaatcatgctcaggtattccatggcaattctaagggaaaagtggaaagagcctttaaatcagtaaaagagcagtggatgtacaatactgattttaatcagttcaaaagtatcgaagatatagattcagcttttgccctatatgtcaataagaaaaacaattcaccacatgcttcactgaatggaaacactccagtaaatgtttttatggatgatgaaacatcgatcagaagggtcgaaccagagaagcttgaaaaaatattttatcatactgcagtcagaaaagttgccaatgatgcaacgatcagactcaatacaaaagtttacgagacaaaacaggagtatataggcagcaaaataactatcaaatataaacctgatcttagtgaagtttatatatttgatgataaaagttatataaagatctctgaagtaaaaaaagtagacaattccagaataaaaagaaagcgaccgctgttttcaaaggaggatgaccaatgaaagattttaagatctattatggacttgaattcaatccatttgaaaagggacagcctgatataccggtagataccggtgattatcaggaagctatgggaaggctcgattatctaaaaggtgtcagagggataggattgtttaccggccgaagcgggacaggcaaatcgtttataatgaagaaattcagtgaaacactgaatcctggtctatataaagtaatatatatgccaatgtcaacactgagcacgatcgaattctatcgtgaactgagccatcagctgggactggaaatatatcataaaaaaatagataatttcagaaatatccaggcacatataaaaaagatggtcgatgagaaaaggatcgtgccggtcataatattagatgagggtcaatttttgaaaacagagattctgaacgatctgataatgcttttgaattttaattttgattcgagcagttatgtgattctgattctgacaggaacaccagtattaaatcatacggtcaatagagcagttcatgaagcactcaggcaaaggatcgtgattcagtatgaaacaaccgggattaatgagaaagatattgaaaattatataaagataaaattaaaaaaagccggaaggaatgaaccgctggtcatgccggaagcattgacggcgctgtcaaatgcctgtcagggttcatcaagaaaactaaacaatctgatgacacactgtttgatagttggagcagcagcaaacaggatgatgatcgataatgatacggtaatggaggcagcagatgaaatcggataaaaaagaactgatatatgaatgcagctataaaaatatgagatggaaatgcagaataaaagatatcgaacaaacaaagcagataacgggatttacagtaagtggaaaagggagtctttatcgtgtgtatctgatagaattcggtaaaacaagatggctggatattccagagatggggatctcaagtgaactgagctgtcttgatgatatcttctggaacagtgaaaagctggcagaacataccagcagtataatagatggtctaactatagccaatgggcttaaaattatcgataatttttttaaatgaggagagagataagatgaatgcagaagattttatagaactggcagaatatctaaaagaaaagtacgttcctaaggatgggtgttttgaaattgaactatacagggtactaagcagtatagaagaaagacttagtgatatagcaggatatttaaaaatattatcaggatgtgaagaaaaatctgaaacaatatttgatatagaaatatagtagaaatgacagtctgattgatattataaaaatatcaatcagactgtttttataatatttataataaaataatttgaagaaagtggttaaaataatttgatcattataattaatttataaaaaagcatttcaaaaataactaatttaatctgaaaaaagttatctaatataattcgctaatcaacagttgtggttctataacatgttttaattcaaaaccttttgataacaaacaatttaaataagtagttaatgtccgatgatacttaataaccttctccccaaggaaaacagcttcgcgctttccttcataataataattatctacaggaaaatgaagaatattaccattttcatcaaaataccagtcctgactaccataacttgtaaaaaccggatgttcaaccgaaaaaacaaattcacccttttcttttagccacactgcaattttttctaccaatccttcaaaatcttttacataatgaaatgctaatgaactgattatgatatcaaatttattttctgaaaaatctaaatcttccattgcttgacatcgatactcgatctttacatcagcattttttcttctagctacctcaagcatcttttttgaaatatcaacacctaaaacataatttgctccctgctctatggcatatgcacaatgccagccatatccacagcctagatcaaggactgttttatctttaaaatcaggtaaaatcttttttaattcatgccattctccagcaccttctaacccttttttagaacgttccatcattccatatttttcaaaaaattgttcattatcatatttattttctttcatcttttcctccatttatatccatctttttcacctaaacttcacggcatgtaattaaaatttgttattatcctaaatgattttgatatagctaagatatatatttttatcataaacaacattcttgatatcatatttatttcgatcaacaacaatattattttagcacttatctctttaaataaaaaccacgcctaaaagacgtggttttctctgaggctataagcctttgttacttgctcgcgtctcaaggcgctgctttcacttcgctcaagctattgcttttgactctcgctatccctcaaagtgttattcggtggattattttaattaaaataacagctatttagtcaaacaaaaataataaacatagaaaaatagttaaaataatttgataaaatgataggcaaattattttaactattttattattatataaaggagctgacatacaaaaaaagaaagggtcattggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcgctgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaatagtgaaaaaatagcctgttatatgaacagtattattgatggattgacgatagcaaaaggattaagtataataagcgctcatatagcacaataccaggcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacactcaaagggattattttcatttttttacttttttcttcttaacttcttgttttttcttttcttcctctatttccttatcctcgaatggattttggtattccttcacactcaatttgtccatcgcaatatcatgtcgttcctgttcccttatatactttgcgactgttgcatcattcaatcctactgtactcacataatatccttctgcccagaaatgtctattcccatatttatattttaaattcgcatgtctatcgaaaatcattaatgctgattttcctttcaaatatcccatgaactttgatacactttcctttggtggaatcattactaacatatgtacatgatcagacattaagtgcccttcgattatttccactcctttatatctgcatagcgtccttaaaatttcacctatatcttttcttagttgattataaatcacttttcgtctatacttgggtgtgaagacgatgtgatatttacacatccactttgtatgtgccaatgaatttgctttttgagccatacttctatcacctttcctttcatatatgatagcttgaacaactttaatatatatcggaaaggtgaatatttgtataacttttttatcgctccacccgcatagcaggtggttttttatttcgcatacttcgtatgctcaactgacttaagtctatatattcatacaagtatgaatattaaaataaaaactcttaaactaatgatgaaaatcattaatttaagagtcaacccttctataagttattttaaaatcaaaaatctaggcataatttatatttaaaaagcctgcttcgttatcctattagaaacctttttccttcgttcctgcaatgtaaaataatcaagaacataatcacctgtagcagtatgaacactttgtttccttttattcaaagcaatatttttagatcttgaaacatcaatttttcgacaacttttcttaggaggatttgtataaaatctagttaccatcattattgcctccttccattacatcatacgaaataattcaaaaatcaattaatgaatttgaactatgcaatctaaaatcaacaatattatagcataatttattcgattcaatcaataaatattcattttatgaactcaaaatattttctcttaacaactttaaaacttcaatttcacgttcaacactagtttctatcgttgataaaaatgttgaaaaattactattctttcttacaaaatcaagccattcaatgatttcctttttcgaatagcccatatctgtaaactgagcttctaatagtgcaaattggaaaagcaaatcagtattaaagattgccggatcatctgtattgatcgtcaataacacttttttactatgatcgtcattaaagccaattgcgtctaaatttaaatatggtaatagtgttacatcatcaacatcaccaatcaaactattcgataccggatttatttctacaataattcctttattagcaaccttgtttctaacatatttttgtagtgtactatataattcaaaatcatcgatattttcaacaattaaaacagattcattcattttacttataaaatagctacaatgatcagctactaataattcttcaagcgtccatctaaaatcagctttatttaaacttttattcttacaagcatgtgaaaaataacaactctttttattcatttttagcacttttttatcaatacagctaaagttataattataccagtcaactaaaacatggatatcaaccgtataatcttcattttccgaataaatttctctaaaagtacttaaaatcttatctcttaataaactctcactaatacttaattttaagtctttcttagatatctgaatatagatccagattaaattttttaaataatcaatcttttttatctgcgtaacttttttatcccgaagataacgttttaaatccaaagctaatgctaaaccatgaccaattcgatcaccttccatatagttaaaatgttcaatcacttcatcaacatgtcgcaaaccactgacaatactagaaaaaacctcaccagcatggtatgtaaaccctattcttttagcgggaaaaatatcataattataatatttttcaattaattgctgattctgtgattcttctattatttcatgatggggatttcttattaaacgatataccggagcataaacatatggttcacaataatgttcatttcccgcaacatcgataccaatgatataattttccaaaccttctatattattacgtaaatgctgtaaagccataacattatttattaactcatattgtaaataaccgtgttttaaatacttataatcattacttgtagcaaactctttataacatatatgatcaactggtcttttctttttaaacattacgataaaacctaatttcattgctcgattagtaatcgctatttttttataccattcaatatgataattaactaactccaaaaccttttccttataagaactaattaattcattaagattcacaccaggaatataagcaattttaagttctacacctttaatcttctcttgatgataataatggtcaagaactaaatttaatttatcttttaaacaaatgcatttattaacatttgcacgataaaaattactaaaatatgacaaacctttaacttcttcagtttgcactttcaaggcaaaaacactatttttaactcgcagataattaaagaaacactggttaaataaagttttttgatacttatttttcttaatatattttaagcagtgatgaataaaaatattctcgctttgaacctcattttttttaccaataaataaactaatataatcgttgtaattattatcacaattattataatcatcgcggtgatatgtaattatctccatatcaatattttcaataaccttatttatcaaatctcgatcatcatcattaagtttacctgaagcatattttgtcaataagatataatcactatcatagacctcctgatcaaaaaatattattttcatcaaaatatagcgaatcgcaagcgacgctaaagaaaacagttcataatcaaaataactactcttgatcttgttgactttatttaactcactaagcgaacgacgcacatcatagtttaatggtcttttaccaatcatcgcccaccattgtaaattaaaaccaatagcaccgccaaagtgaacatgcgtttcataaaacccttctttaaacacactgctttgataattatttaatacatgaatatgtaatccttcattactgcatataaaatcctcaatagaagtaacaaatctatttaaatgattaataattactggtgtcatttccatccaccttgaaatataataccaaatcaggattctttgattttcgttatatgcagaaaataaatcttttcgattattgatatacatctgattcaaatagattttataatcttcaattcttaataaagacgaacctaattttcctagcaaatcaagataaaattgtgttatctgatcatttttattacatttagcacctctaccctggcgaggaaatattttttcaagtattaggataaactcatccatatccctaatcgaaatctcattttttataatactaaaaatcactaaaataaattcatcatacgttatttcaccatttaaatattccgcataataatcatccttaataaacctaaaatgacgatatggtaatgtaacgatggcaattgtcaacatcaaattataagtattcataattacaactctttattaaaaacacttagtaaattcaagaaaaatctacgctcttcattatcgctacataccagatcatataaatataaactcatgacataaataggggttatgtataacagtgcctgagctttagcaagcattttatctcgatcaaaactattttgatcatttaccaaattataaagggctcttagctcatccataatataatcacaacatttatttcgcactaccgtttcatcacttaatttactaatcaaattcattaatttaggtctaaaattattcatccagtcattattatcaactacatcataatatatttgaacaataatattaaatacttcctgacttaactcactactttcatcatcttctattttaagataaatatcagcgttattcataatattgttatgaatattttcaacatcaacaatatcataacgatgataattttcagcttctaaataataataatcaaaaagctgtttagttaaaagatacattttttcaacaaattgtttctcacaacccacatagttactttcaaattttctcactttttttacgtaactatttatttgctgttcaaagtatagatcttctaaatgatcgatccgtggtgtatcattgttatttgaatatttaggacgagcatttttagataaataataactgctaattatttctaaatatgtattattattaggaacttcactatatttaatgctttgtaattcaggaataaatttatcaataatatctataaaagtcttaatggttttttctttcataaaatcaccgccaaaaaagcgaatcatattttcatcattaaaaataaacgtaaactgctccaataattgtgatatatcaaaaagttttctattcaactgctcactaacgaataaattccgtatatcatcaaatacaggaataatttgatttatataatatttcttatatggataaagacctttcatcaatgataaattattctttatcattttttctaaattacttaaccaattataattatcatcaatataatttttaatcaataattggattatatctctttcatatcgagatctttttatcccgtttatttcaatcccatagcatagctcatcatagatttctttattaagattgctatttccatcattaaaaatatcacatgctgccttcattatttgcacaaaatattttttatcattattttcattatataatcttgcatttgtatcatagttgactacactatcaccattgattgcattaatggctttcattgacattcttgtggtaatgtatgaataaaataataaagtatctttaatatcagcattatcaggtaaaaacaaagttatattttgattaaaagctcgaacaaatacatgaacaaaaatatttttcaacttatctctaactcttttgtaacgcttatgataatccgttttaaaaaaacaatttagcagttcattcataaataaaggcagaataatcaaagcttctatttcttctttataatcatcccgaagatattttttattctcattattttcagacttgattgcctcataattttcctttatcttttcttcaacaacttcttttaattcttcacagtcgatccttaatttgtcataacatttctcttcgtcatcctcataccttttttcatttttaatatataaatagcgatcaatattatttaaattttttcgatacgtattttttgaattcaaaataattcctaaaaattcctcaataaaaattattttatctttattagttcttagtttttgataattttgacgacataaatatatataaacattcataaaacctctgacattagaactaaaggctgaataataagaataaattaccgtcttatcttttttaaaaaagaaatcttcaccatcatcatcaagacaaatattagctaacaattcctccaaagtcttatttaaaagatcattagaatctttattttttacatatgttaacttacttttcttacgattatccaaagtcttgatctcaaatcggtataatggtggtaatactttttttaggaaaaattcactacgactcttagccatttctaaagcctgatattgcttttcattttttccaaacgaatatatctctttaatatcacgattatctaaattttccccctgtaacattttcaatgttatcgactggcaaaaaagatcataatcaccactaataaatgtaacaatatgcgaatgcgataaaaatgttaaaaaatcttcaaatattgttccacaatattttgctgtcatatcaacatcatcaaagaaaaagaaaatcaacggttcttcttcatagccataccttttattaattattcttttgtactcaattaaataatcaatcaatgttctaaaagtctccacaacatcaaaatcctgactttgaatttctgttgaccgattaacataatcaatagtattttgatactgtcgattaataatatttttataatcaattttacgatgctgataattcttttttaatacattaaactgattttcaaccttcttttcaatttctcgggtatcatcttcacgattcaataaacaagttgctctagtgtaactttttatttgatcattatacattttttccaaaacaacaattatccagcctaaaatatcacttgtttcactcatatcatcgggaacgatcagagaagaaataagatcatattcattgaaagatatcgttttatgattttcagaaaaatactgatgactttcaatttgcttgattattgtcatcataattgatgttttccctaagccgcgaccccctaaaatagaaataaaattatcatatttttcataagataatctttttaatttagtatcactatttctagcattttttcgaaaatcactaataaaatctttgatgttaccaatgttaggtaacatcagtttaacattctctaattcaagttctcttgctccaatatgataatttatttttttatcgtcagtcatttaatttttcctcccctcagtattattttgcttcttatcatcatgttgtttattttctaaaaaatctaaaaaatatgttaaaactaaaatttttaatttatcagcaaacattaaataccgattttttaaaacaaaatatccactaacacaaataacgattgccacactataaataatatcaaatttaagaccacctgcattagtaaacaaatggtaattaaatataaacgctagaaataaacttaccccagatagatttttagaaaaagattttgatgaattgtaattatgaacacgattatatttttcattcgtttgaatcagcatatatgaactagtactcattgattctactgccttttttaggtcgttttcatttttaagatcaaaatttttatcaaagtcttcatatagttcaactaaatatttataacatttcttaattaaaatcttatactcaatagtatcatttcttttctttactttccccgccaataatataaatacgatccatacagtcattgaaaataccaatttaatattatctattttaaatataaaagctatggcagtaattatatatacaactaaataaagacaatttatatttatctttttttcaaagaaacgataaatatatttaatcatttgtgataacatccaacccacacaataactaaaaacaataaccaaaccaaaaacaaaccactcattatttatttcactaataagccttttgatttcagttggaatgattgaacaaacaccaataaaaatcattattcccggtactattgttgaaacaatatcatataatgttattttattaattatattttgcatatctaaatttatcccctttctttaaagagacaactcaaaactctttttatctcatatccacatcaaaaaaagcccatttaatcacgtttattcaatcattataactaattatatcttatcacagagccaaaaatatataaatataattcaatcataaaaattaccaagacaaataaaaagccgatgagatctcatcgactatcggcgcggaattattattgcagcaataatatatgcccaaaaaccactaccacctatggcaaataaaacaacccaagccaatctcactaatgtcgggtctaaatcaaaatattcggcaattccaccacaaacaccacaaatcatcttttcttcatctgaacgatatatacgtttcatttttatacctccatttttattataatatttcccacattacaatcagcttcaatcatccgatcaccgccattataataatattcatcacttaaaccttcgccacgataactgcctacttgaatatcacctaaatcacagtctacatcataactatagtcactttctgtccctgtcataacaactttgatatcccctacatctacattaaattcgctttttttactatccagcaaatcaatttttgcttcccccgcatcaacatcaacaaccgccttttcaacagtaatattatctgctttaaatgacccagcatcaacatcaacctctaattcatcagctatcaaatttgccagctttacacttgcagcatctatttcaatttccactttattaaatcgataatctttaggcacatatatctttacatcagtatcattaacaattggaaaaccaaatctaaaattttctttaaaaactagtgtttcatcatcttgatatacctctgtacgccggctaatattttcagcttttatttcgataatatcaccactatattcaacgatttcaaaattacctgttgaagcttcaatatctaaatttttaatattctcaaactgtctttttacatcttttgttttaacaaatggtaatgatatgttcaaatcatcttgatgataagcattttttaactctgtaagaccatctaacattacccctgatataaataaaattatagctacaattaaagatattattactatcaaggttgattttttcatatcaattcacctactttatttataattgtttttactagatttattcccccattaattaccaatggaacagctttgatcaaggccttttcaacaacaaaaaaaccaacagctaaagcaattaaagcaaaaccagccgatataacaatcaatcccatgcccggtgttgctgataatataataagaccacgaataaaacaagctatagctcccgctaaacatatcactccgccaactaaaattccaattcccacagctaaaacaactgccaaagcgcttattccaacgccaaaaagaccgctaaaacctaagattactattccaattagaatcaaaataattaaaattcgattacgttcaggattacctttaaaattattttttcttttttcatgatgattttcatgatcaattacatcagcttcaattatctcacttgcctctttataataagcattatccatacccttttcactaaattcaatatcatcatcaaatctattttccaaaccagctttaataattgcagccactctttctggagaccctagatcattgattaattgagtctcattttcagcccctgcttcatcaaaataatcttcgtaatactgtaaggcttcatctcgttcaacatcttcaatatcttgcaacaaataagctaacttctcaagaaatctcttacgatccattaaatttatccccctcaataataaaatttatcttttgaacatattcatgccactcactacgatacatctctaattgtgcctgtccctgagctgtaattttataataacgacgatttctcccaccatattcttgatcatatgtctctaaacaattatctcttaataatcttcttaaaactggatataacgttgattctgaaacatccagtgcaattcgaacgtcttgagtaattttatagccatatgtccccttagattctcttgaaacaacagaaagcacgatcgcatctaacaaagcagcacctgtattaaaaatcatcagttccactccttctatatttattatccaataatattatatatcatataatattgctcgtcaatcaataatatataattataaacataggaattagtatcgttaatttgttaattatttaatttttttagataattttcccacatttatcctaaataattattaagtaaggaggtaataatgaagaaggcaaaaaaaattatactaatctgtgcaggtatcattgtaataggtttagttgcgatattcttatttacaaatgattctccacaaacagcagcatcaagcaatgatagtaatagtattgattatattgaattaacagatactacagatgatatcagtaaaatctatactcttgattatcaatctgaaatcaatgaacaaatagaaacattaaaaaataaaaataactatactattaaagaaccattattgatcgctaacccatacggtacaaatacaactgctgtttacatgtattttaaaactgatgatgaatgtaatgcatcttatacaattagtgctgatggctatgatgactttttaagaacattaaataacaatagtaacagtggttatacgacagaacatgagtatttattagttgggtttgttcctggaacaactaacaatattaccgttactttaacagatacaaaaggaaatatcattgatacattagattggtcatatgatgcaccagaacttcttggcagtgaagataatattcaattagaagttactaccggtaatagcagcgaacctttaagcgatggactttatgcaatgcttggtaaccgtacagccgaagacaatgaagaagttgattttattctactatatgataataatggaacgattcgtagtgaaatacctattacaagttatcgaagctgtcgcgttatttttgatgacgatatgatgtattatagcatctcagccagcaagattgcaggaatgaataaaacaggtcaagtaacggaaatctttaatacaggggactataaactacatcatgattatatttggggtagtgaaaatgatttaatcgtcttagcctctaaaaaggatgctgaaacaaatgaagatcgtattattagtattgatcgtgataccggtgatgtaaaggagctaattgatcttaaagacctttttagcaactatttcaatactttaactattagtgacgatagtgatgaagcatttgactggatgcacatcaattcaattcaactaatcaatgaagacagcataatcataagttcccgagaaacttcatcaattataaaaattgataatatctatgatcaaccaactgttgattatatgatcggttctaaaacattctggcaagaaagtggctacgacaacttagttcttgaacaaattggcgatttttctttgaatgctggtcaacattgtgtcacttatcaagaagacgattctttagctgatggacaatattatttatatttctacaacaataataatactgtatgttcaacccgtaattatgattattcaaatgaaactaattatgaaggagcaagtattggtgtaaatggtgaacaatcttattatgacaaatatttggttgatgaaaatttaggtacttttgaattagtcgatcgtatatcagtaacctattctggttatgttagttcagtacaagaattagatgataatatcatcattgatagtggaagtgcttttgaagcttctgaatttgatagtaatcatcaacttattcaaactgttgttggtacaggagacacatggtggtatcgtgtgtttaaatatgattttaataactattggtttcaataaccaatagtttttttataaaaaagatacctactagtaaggtatctcgttaaatcaaaatattatttatacttttctgtatgtaataatttattagcattatctattctatcttgagtaggtggattaactccttctaattgatatggaatatttaattcctcccatttgaatgttcctaaagtatgatatggtaatacctctactttttttacattattaagactattaataaatttatctaattcaattaaatattcatctttatcactaattcctggaactaaaacatgacgaatccatacaggctgatcaatttctgaaagatactttgccatatctaagatgtttttatttgatttacctgttagctttatatgttcttcatcatttatatgtttaatatctaccaataataaatcagtatatttcattaattcattgaacttactaaagaaaggttcttctctagtaaaattagcaccactagtatcaatacaagtattgaccccttcttttttagctaatttaaacaactcagtaataaaatcaatctgtagtagtggttcaccaccactaatagtaatcccaccatcatgaccccaataacttttatatttaattgctctatctaaagcttcctgaggtgtaagttccattgttgctttagcatttgcccatgtatcaggattatgacaaaatttacagcgtaaagggcagccaagaagaaagtatatataacgaattcctggtccgtcaacagacccgaaactttcaatcgaatgtactgcccccataatcttattatccattttattcttcctttcattattaataattatttccaataattatctcattaaaacagcctctttttaaaagaggctgttttgcttaaatttcaataactattacattgatttatggcaagttcttgaaataacatccatttgttgttcacgagttaaatcaataaatttaacagcatatccagatacacggattgtgaagtttgcatattcttctttttctggatgttccatagcatcgattaatttttcagttccaaatacatttacatttaaatgatgagcaccttgatcaaaatatccatctaatactctagctaaagtatttttacgttcatcatcatcatgacctaaagtatcaggactaattgtttgtgtattagaaataccatctaatgcccattcatatggtaatttagcaacagaatttaatgaagctaataaaccagattgttcagcaccatatgctgggttagcacctggagataatggttctccagctttacgtccatcaggtaatgaaccagtagctttaccataaacaacatttgaagtaattgttaagatagaagtagtaggttcagaatcacgataagtgtgatgttttttgatcttttctaagaaagtttgtaataaccatactgcaatatcatcagcacgatcatcatcattaccataacgagggaaatctccttctgtttcataatctacaacaataccatcttcatcacgaactgttttaactttagcatatttaatagcacttaaagagtcaacaacatgtgagaatccagcaatacctgttgcaaaagtacgttttaaatcagtatcaattaaagccatttgagctgcttcataataatatttatcatgcatgtattgaattaagtttaatgtatttacataaatatcagctaaccaatccatcatttgatcatagcttctcataacttcatcataatctaaatattcagaagtaattgggcgatattcaggagctacttgagtcttagttttttcatcaacaccaccattgatagcatataataaacatttagctaagttagcacgtgctccgaagaattgcatttctttaccagtttgtgttgcagaaacacagcagcagattgaatagtcatctccccataccggacgcattacacaatcgttttcgtattgtacagagcttgtgtcgatagaaatcttagaagtatatttcttgaagttttctggtaatctagaagaatataatactgttaagttaggttctggagatggtcccatgttttccaatgtgtgtaagaaacggaaatcgtttttagttaccattggacgaccgtcagatccaataccagctacttctaatgtagcccaaactgggtcaccagagaataattggttataagaaggaatacgtgcgaatttaaccattctacatttcataacgaaatggtcgattaattcttgagcttcttcttcagtaataactccagcttctaaatctctttcaatataaatatctaagaatgtagaaacacgtcctacagacatagctgcaccattttgagttttaatagctgctagatatccaaaatataaccattgaacagcttctttagcatttttagctgggttagaaatatcataaccataaatttcagccatttttttcataccgtgtaatgctttgatttgttcagcgatttcttcacgacgacgaataacgtcttctttcattgaaccacttccacaaacagctaaatcatgttgtttgaaagcaattaattcatcaataccatataaagcaacacgacgataatcaccaacgatacgtccacgtccataagtatcaggtaaacctgtaatgatcttattacgacgagctaatctgatttcaggtgtatatacatcgaaaactccttggttatgagttttgtgatattcagtaaagattttgtgtaattctggatcaggtgtatatccataagtttcacaagcttgttcagccattttgataccaccataaggcataaatgctctttttaatggtttatcagtttgtaatccaacaactttttctaaatctttaagttcttcatcaatatatccaggaccgtaagcagttaatccagaaactacatgagtttccatatctaacactccgcctttagcacgttcttctttttgaagttcttgtaatttcccccataatttatttgtagcatcagtaggttcagccaaaaatgattcatcaccataatatggcttgtagttattttggatgaaatcacgaacattgatttcttctttccaaagtctacctttaaagccattccattgttctttttttaacatgtctttttttcctccttgaaattttaatgaccgttagttaaagctcttacaaggttttaaataataatccgatggattttgcaagggatgtcatcaagactaatattctacttctctcgtaataaacttacttaacaagaataacacacactatatttttggaaaatgattttatttccttttgttatccacgcttgcattatattatattttgtttttacaattcaagtaatttgcactaaaaaaacaaattattttcaacaaatttctataaccttataatatataatgtcccgcccctaataaaagcgcttacatatagtgtatgattactaaattttataaaaatttaatccatttaatagtagattttttcttttatttattatatagtattatctaaagttatcaggaggtaaaataatgaatttaacattcaacacagatgctgattttaatcaaattaaaactattgtaatcgatattataaaaaatactgctaatgattttgatttatttctttcaacaaattcaatcaataatttatcaattcatttaagtattgcaatcataagaataaaatcagacaactacattccattaagcaatggacaaattgcatcatacaaacaggaatatagctacccttatgcgaaaatgctatgtgatcgtcttgcaaaaaaatttgaaattgaatttcctgaagatgaagtatctttagtttcaatgcatttatctaaaaatcaaaaattagacctagaaattaattctggattcgacttattagatagtaaagttttcaaaattcttaatgaaacaatgactttgatttatcaagaatatcacaaagactttagaaaagatgataaattattgattgctattggtttacatctagaaccagcaataaaaagattatcaaaaggacaaactattgaaaatccattaaaagataaaatcatagaacgccataatgaagaatataattatagcagaattttaaacaaagttatcaatcatgaaacaaatttatcattcaatgatgatgaacttgcctttattgcccttcactttgtagttgcgaataatcgaattgataattaaaaacactataaaatcacattataataataaaaagacaataggtcagaatacctggtaaatattgtcttttttaattctaaatcttcaacataaaatccaaactatttttatgttacaaattatttatttttctttttttacttttacaaaatattatcgaagccaatactagacctgcaaacgaatatattgtatttgttgtatcatcagtatctactgccaccactgtatctcctacatttactgctgtattaatatctacttcattagctattaatcccgcaattgcttttgctaaaacatctttagcattatctacctgttcttggtttgcttctggatcttctaataccgcttttgcttcatttaaagcatctgcgactactgcccatgttttagcactgtagtttgcagcgtttaagttatttgctttattgatcaattcttgtaataagtctttatttggttttaatcttaagttcaagaacgcttttactaattctgtaaaggcttcatctacttcaccttgcattgcattaacatcagccaatacaacatttgcattatctaatactggtaacatatcagaccatgatgattcaatgtatttactttcatctaatccattgatttgatctacttgtttttgtaatgcactcttatcaccttgatagaattccaacatctgcattgcccttgctagtcgatcaaaggcattatttacttcttcttgaactgctttagtattttcgtatactgctttagcatttgttaaagcttcattgaattcagttactacggctggtacaacattttctaaacttgctttttccgccatttcaatggcaatttgtaaagctaatttatcagtctcaacaatatttttaaatactggataattattttcaccacttatccatgcacaatattcagtatctaaattagcattcaattcgtttaataatgttccatctgtaaactcatcaaggctcaagccatttaaatcttcaaaattatttgtatttccaaaaccagctttactactttcataataaatattttgataagtaacttggtatgattcacctgcaacagattcatcatatccggccactacaccactaaatcgaggtgctgttacatcagctttaacataacaattcttgataatagttggtgtgttaggatcaatactgcgattagctgcaccaactaaaccacctgctgtttctactgttcctgctacttcactccatgcataacaattaatcatcgttgaattattaaacattccgacgattccacctgtatcattgctgccattaacattagcttcaacaccacaatttataattgtcgcatacatcgtccgtccaactaatccaccaactttagctttaccagttatattagcgtttctaagctcaacatttttaatcgttccgcgttctaataaaccaatcagcccaacattttctccttgtggctgattaatcgttaaattagagatcgtatgtccatcgccatcaaaaacaccattgaatacagctgctggtgtatatttataattttgcatatctaaatcattagttaatttaaaatatgcttgcatcatttccccactattaatttcatttgcaaacaataataattctttttctgaattaatcaaatatggattctcagcagttcccgtacctgcaaattcatattctaaagatgaatcaagattttgattatatttatttccaattgttaaattatctaaataaccattaataccgttaaacatcttattagttggtaaatatgatgtcgctgaatgtgacgaaacacttgcaggtccttcaattaaagtaggattataagtaataccatcaacttttaataatgttgttgcattaacaccatgaatatatgtacttgttaaagtaatatttaaccattcatctagcggtaaattaatattatacgtataaatatatttaccaactttaaaactaacaccctgattttgataattcaaatagaacgtacaaaaatcatcagtaaatagcacggcatcatctctttgtgtgcctttcaaatataaatcaaaattgactgtataaggataaccaacacttgcaaatggtaaagaaagattactttgtggttcaagctgtaaaacttttccattaagatattcttcattcattgtcgcaagatcagcagcctgtacttgagcatcatagccattttctagatcattaattttcagatcagccatttcttcaaaatcatacttagcgataatacttgaatttgtagctacatactttcttggattagcaccaggggcatagtcaccaacttgttcaaatgcttctacaaaatcattaccactttcaaaacgatcatcatcaccataccagctcttttcactaattacaccaatataagataaaactagatccaaaacatcaaaatcattagcccaagaacggtcattccaattacagaaaagcgttccaatgatctgtggatttccccgtaacaaatcatattgagcataataattacgtgaagctatataagtcggattaccaattcgatgggtatcaaaatcactgcatcctctccaggtatcatagaaagtcgccatatctacataaccattatgcagaccattactattacctggaatcaaatacatgctattagaagttgaattgatgatttcaaaaccatctgctaaagcttgttcaactcgctgatcagcagaatcccaaatttgattaacaacatttttagaatcaatttcactagccccataataaacagagagattaccccaaaaatagactttatcgatattatcttttgataaacaatattgagctagatcattaatatagcgacgcatattttcgtttgtattagatgattcatcagttccaatatgaacagcagcactttggaatactggatcatcaccgtctaaaaattcatcaaaaacactactgatcaaatctaaacattcatcatagtgattacttaaatcaaaattagagccgttaactatttctggatcaattaaattaaaaattgttgcatgtccaggtgaatcgatttcagtaataacatcaacaccaaattgtttcaaattcttttgcatctgacgataatcatcttgtgaccatacataattaccattttctaaattatatgtattcaagaccggatattttttactttcaactacaaatgaagaactgtactcaccaccaagtccactatcttcattaatatgaagatggaatgtattcattttaaaccaggccatatatttacccatctcttcaatgtaatctaaatcaaaataacgtctagccacatcaagcattccaccacgaactgagtattgtggataatcgcgaataatccccaatggaattgtatcatggttttcatcttgatataaaatctgagcaatagaaacgccaccataaagcattcccgtatcactaggtgcactaattacaacctggtcaccaatattaatataatatccttcatcacctaattcatttaatttatctggtgtatatttaataacaatatcaccacttacagcggcagcttcgcttacttctaatgttactcctatcatttcagttaaatacatttgcagcattttggcacttgttttcgccatttgatcttcataaacgatccgagccccattttcaagtttaaaatcaccatctagaccataccattcttgaagaccaggaacaacatttggcattttattagtacctgtattactatatttaccagcaactgtaacagttatattacgatcaagccggcatactatttcactgctcaaagtatctaaaatatcataaatcaaatatactttttgctttgttaaaggctgataaacatgaccatttaaatcaataacctgttcattacttgaaccaaataatacagcctgatagcgatcatcatctgattttggtaaaactaactgatcatctataatttcaggctcattttcaataccggccataaacttttctaattcattagcatcatcaaaaatagctaatctagctacattatctgttcctaatttccattcactataattttcttgacaagattgattcaatgtatccacaaaactttgactcatcatctcagctttattcattcctgtaatagttgaaactgtaacaagatttccaattgcaacatcaggtaaattttcttgattgtaataaagatgatcataatttgcaagattgtcatcttgttcaataaatccacctattttacctgaataagttccccaatgaactcgtcctaaattataagaattaattatatttgctgctactgttggattaagactacgacaaatagaacctgctaaaccacctaatgatttagaaccactgacaataccattattgtagctgtttaaaagatcagaattatttaacattcctacgattccaccaacatcttcaaaaccttttatcgttgcattgttgtaacaatttaaaatcgttgcctgcatacttcgcccaatcaacgctccaactttatatccaccttcaactttaccactatcaattcctagatttttaattgtacctccttcaacttgatggaataatccaatgttttgaccattatctactttaatattgatatttttgataacatgtccatcaccatcaaaagttcctttaaaaggaataattgaactaaaaccattaaattcaattcctttcaaatcaagatttgcttttaactgataataagctgtcgaaaattccgtggccatattaacgaccctttccatttcctttaaatcatcaaccgtcttgatcaaataaggttcttctaaactaccatgtcctgataaagttgttttaataaaaaccttacctctaaatcccggatatccagtgttatcttcaagccacgtaaaataatcagcagttaaattattatttaattttataatcaactcaccattactaaattcttctaaatcaattggaatcaaaccagtacgattatcattatttccaatagctatttgattttgttcataataaagattactcatggtaattcgataattatcactaaccgcgccttcatcataacctacaatgatccctacatgctgatcaccactaacaacagcacgactataacaattatctatagttgccataaactctggagcaatactacgattagcacttccaacaacgccaccaacagttatcttaccgctaatatttccccaaacataacaatttaacatagtagaattattaaacattccaactattccaccagtatcattagcaccttcaacattagctttactgtaacaatttaagatcgttgcctgcattgtttttcccactaaagccccagtatgattaccgccaataatagttccactttcaattccaagatttttaattgtaccaccatctaaaaaaccaattaaacccacattttctaaatcaggttcattgatatttagattcaaaagataatactgattaccatctaaaacaccactaaaacgtgtaatcggctgaaaatcgatatcattcatatcaatatcactagttaatttataataagcatcaccatacaatgcatcatcattaataatctgtgacattaatactagatcttcgggagttttaattaaatatggaacatctttagttccttgtccaatcaaaccacattcagacataccatcattaaattctggatatcctagtgcgcctttgacccatgggctataaccctcttcacagccactgtttaaagcttctaataaacgtccatcttgaaaggctgctgtttctatgccatttacacctgaatgactgctattaccaattcctgttaccgaactgtcatagtaaatactgctcatggtaatttcataactagctccagcaacactttcatcataaccaattgcactacctacatactgttgaccaacaactgtagctaaactataacaattttttaacactgttggtgttgccggatcaatactgcgattagcaccgccaactattcccccagctgttactccactactatttatttctccccaaacataacaatttaacatggtagaattattaaacatcccgactattccaccaacatcatttttcccatttacatctgctttactgtaacaattaatgatattagcatacatcgttcttccaacaagggcaccagttctattaccacctgtgattacgccactttcaattcctaaattttttactgttcccccatttaaaaaactaatcaatccaatctgatcaccagtactattgattactaaattagaaattgcataaccatttccatcaagaaccccagaaaaaccacttgtacttccgatcggtgcaaaatcaatttctgccatatcaatatttgtcgtcaatttataatgagcatttaaataactatctccattatttacaagtgaagacattttaattaaatcttctttcgaactaattaaatatggatcatcattagttcctttaccttcaagatcattatcttcaccatgtacaacataaattgatatagatgcaaatataatgaatgtacttaaaataattttaattatttttttcatttctatcctcctttcatacattcattaggttttatttcacctcctctttttttatttattattagaacagtagtttactgttaataatccaaaaaatattaaaaggcaagactaaaaacatttagtttctggtcttgcctaattaaagtaacaatcctctattactttaattataatttttattaactaaattgtctacacaatttaattaattacatcaaaattttactttttttaacataaatatcaaacttaataaagctccacaaacaaaccattcaaaaactggcacattatcaccagtagctacacttaccgtagcttcagttttaacagtatttacttcctgtaattttgccatagcctttgctagtgtatcttttgcattgtccacctctgcctgactagcttcaaaattatctaatacttcttttgcttctcctaaagctttcactactacattccatgtctttgcactataatttgcaccatctagtgattgcgctttatcgatcaattcctgcaataaacttttatctgggattaatcttaactctaagtatgcctttactaatgcattataggcattatctacttcttcctgacttgcactttcattagctaatacttcttgggcctcttgtaatactgggattagatcattccatgttttatctgtatatctgcttacatctaatcctaatactttatttatcattgcttctaataacgatttatctacttcttttacttcttctaaattatctattgctgcttgtagattttttattgcttcatctacttcttcctgcattgcattttcattgtcgtttacttctttggcttcttgcaaagcatttactaatgtttgccatgattcgacagtaaatttattttcatctaatccttctgcttgtacaatcaatccttgtaattcactcttttcacctttatagaactgtaacatatgcattgccactgataaacgggcaaatgaggcatctactgtttcttgactaactgattcatcagctaagatagtctgagcttcctgcaatgctgcttcaaattcggtaactaccactggaacaactttatctaattcagttacattacttgccatttcaaccgctattgataatgcggttttattagtagttataatttcttttaattctaaaccactaattgcagcctgtaattctagaatcatagcatttacttgttcttgagtaacttcattatcttctaaaattatttctccagttttaattacagcttgtaaaatctcaaaactctcttctgtatatttatcgccacgatattcttttgcttcagctaaaatattttcaagcttttctttatctgtttttattcctaaataaatatcttccaaccaatactttccagccgcttgatcgttattaaataaatatatcttcccaatattttcaattgctttagctgttgatctaaaagcatagttatcagctattgctacttctattccatcagctccactaacaaatacactatatcttttagcttctaaatcaactgatattcgaaggtgatatttttcattttcggtaaacttaacagcactttgcacataacttgtgccattatacacactaaatcttccatcattaaacattctaataataatcggtacttgtgagtatgctgtataattagaatcactacttccaagacctacgattgcatttgtttgatttgctggtaaaactgtaaccatatcaaattctacattgactgaattttttgtactaggtccaatcaatctatttgcactaacagctccagcactattagccccaacagaaacaagagcagtatccgatggctttaattgttcgcttcgttcacccaaataaatatcttctagccaatattttcccgctgtctggtcattattaaataaatatatcttaccaatattttcaattgctttagctgttgatctaaaagcatagttattagctatcgcaacttctatttcatcaggtccagtaacaaatacactatattttttagcctctaaatcaactgatacgcgaagatgatatttttcattttgtgtgaatttaaaagcactttgcacataacctgtgccattatatacaccaaaacttccatctttatacattctaataataatcggtacttgtgagtatgctgtataattagaatcactacttccaagacccacgattgcatttgtttggcttggtgataagactgtaatcatatcaaattctatgttaactaaattttcggtatttggtccgattaatctatttgcactaactgccccagcgctattagcttcaacagaaataagagcatcttcactaggtactggttcttctggcggttctgtataatcaaaacgaattggatattcaggtctatctggatattttccatttgtcaatccggcagttaataaatctattaatttagaatccaatatttcattaaataaatttgttttataactaataattgcgatatcattttcaataaccgaaagctttcgattgcttccattttctaaaaccacacttagtgctacataatttactccgctatatgtcaaaataccatcaaaatcattaataccatacacttctttaacaaaagcttcaggtacataaatttcatcgttatatttgatcgtttttaattcacttccaggaactaattccctaattcgagaattaactactgcatatttcgaatcttcttttacagcaacactgccaatcattttcttatttaatgccggttctacatcatcagttacatacccttgattttccagcttagaaagttcagataaaaacattactgttgccgctggagcataactttgcgaagatcctattcccagtgaacaatttggatttggataggcactaatcaattcagaacgccctactaaaccatctggacgaatagcgttagcattcaatcctaaaaaggctttttttacagcaggataataagtatctctatctaaaagaccattattgattccccatgccaaaccatacgcaaagaaaactgtaccgcttgtttctgggcgaatatcatgatcataatcatctaaattcatccgccaaaaaccatcttcaccctgtgtttttagtaatgttgctgccattttcttaaatacagtttcgtactcttctttgtcatttgtgcgatcatctggcaagtcttgaagtatttttgccagtgctcccattgcccagccatttcctcttgaccaaagaatctttttaccattaggactaatcttttgattattcccattactatctggattataggttgcatcagcatcaaaaatataattcttatcacgataaaataagcctgtttcttcatcataaagctctgctttacgatcatcatataattctcttaatttatccagccatttttcttcaccggttagaagatacatcttcgtccaatttggtagttccatataaaagaaatcgattctatcccaataaccatttttattttttaaatcactaatgctcatttgttccatttcattcatgattggaactaaatttcttaatttttcatcatcaggatcaaaacccgaatcagaagtaattgaaaacatgtctaaataagtctggaaactagtatgattatctggaaaatatttacctattctgccactatcagctttagtattccatgcttgatcattatatatattgttacttccccagcgatttgcataatcagtataattttcatcaccagttaaataataagcttccatatttcccgtataaaatactgatggtgcccaaaattcactagaaatagaatgtccatgattataattagtcgcatcatctcccgtatttccacctgtcttgatccagtaatcattaacctttttagctaaattcactaaattttgtgcacttggtaaatcaacattagaattatctgtctcgacaccccatactttaaattctgtcaaggcagaaaatttcttacgtccatcaccaggaatcgtttcttcactaactggaagatcttttaaacgtacccacgaaaccactttcttttctggtaatttgattacctgtggtgatgctaatttttgcaagcttattggcatttctgttccatcagaaaattctaatgttgcacttgtccagttaatatcatgatcattagcattatttggttgtggtggattccattgcgctcttactgtgatatcaatttgatcaatttcaacgtaacgtccaaataaaacagaaaattctgaatctgtcttttcatttccacaaccccatgcttgatatggaaaacctacatgtgaagcattaaattcaaatccatctattgcatttcgcggttcaaactcacgtttgttatctgtcacacgatttgcataagcatgtggaaaaacactgatgtccccctttttattagaacccgaaacaccattatcattaccacgcaaatcaaacggatttaatgctagatttcttcgagcattaatttcttcttctgttgctactctagcggtaattactttttctgtatttccagatgttgaaaatgctcgagaatcatatggccaatttccacctcctaatgtatttccatttgcatctgttcccgttataccaggtatagtaaaacgaaactcattattgattaagtaaactaaagtttcttcgtattctaaagaagccatattagaaggttttatcgatccttcgacttgttcttcttccaatgtccctgtaatttttggggtaccacaatatttatctaactgtaccattagataatgaacaccttcaggtgctgtaatgactatttcatccccatttgttttattacttgagcgtacataatttctattatgtactaacttgttcattcctgtctctacgacattattattttgtattaattcaatttttacatcttcacttactgtttgctcttgaactgctgaaacatttatacttgttgatgaaaaaaccattaatacagctataattgtcaaaaatatctttttcataacacctttcccttttctattatttttataattcttgtttatcctcttttaaaactcttaactcctcctttatctaagcgcttacaatttataataaaaaatatcccctatatttattataaaatcttaggaatatttttatctttagccttattagtattctttttatcttttttaaaatcaatctttaacaagagcatctattattttacagccagaacttgttccaattctgatagacccagcttcaattaattttttcatatcttcatagcttcgcacaccacctgaagctttaacctgtaattcatcaccaactattgatttcattaaagcaacatctttaaaagttgctccaccacttgaaaatcctgttgatgttttaacaaaagctgccttagcttctttagctaactgacaggccaaaacgatctcttcatcactcaacaaacaagtttcaataataacttttacacatttatttcctgctgcctttacaactgctttgatttcatctaaaactaactgtttatttccatcttttaaagcgccaatattaattaccatatcaatttcatcagctccattatcaatcgcatctttagtttcaaaaacttttaccgctgtcgtactagcacctagtggaaaaccgatcaccgtacatactttaacatcactatcaactaattcttcagcacaaaaactgacccagacaggattaacacacactgaagcaaaatgatacaactttgcttcatcaataactgtcttgaccatttttttagttgcatcagcttttaaaatcgtatgatcgatcattttattataattcatcatcactacctccatatattcgttcaatagcttcttttacaataacactatcaccaagataatcagcctgtcccacttctaatgagataaacttttcatgtcctttacctaaaactaaaataatatcatctttacaagcaatctctattgcctgctcgattgcaatttgccttgaaggaatgattacactattaatatcaacgatttcagattgaatagttttacaaatatcataaacattttcgccacgatcatctaactgcgttaaaatcacatgatctaaatatttattagcaacccgtcctagttctttacgtaatttataattacgtttccccggagcacctaacactgcaattaaccgaccacaattttgccgcacaccttcaacaaattcaaaaatatcttcataattgctaatatgttggcaataatcaacaattaccgaaaaatttttttccgtttgaatcagttccatccgtccttcaaccggttttacattttttacagcctccaaaaccatattatcatcacaacccatggcaattaaaacgcatactaaggctaaaacattatatatattaaatttagctaatacgggtgaagaaacatgaaaaatattacctttaaaaactaaatcaaactcactatgatctaaatataaacgaatatttttagccatgacatcactatcaatttcgatcccatatgttaggacctttcctttagtattattttttatctgagaaaaattgatgtcatcactatttaaaacagcccagtctgttggtttgatcatctcaaataacttttgtttagctaaaacatactgctctctagtaccatggaaatctaaatgctcagcaccaatattagtcattacagcaatactaaaattaacactatcgaccctacctaaagacaaaccatgactcgatgcttccattgctacaactttcaccccaccgcgattcatctcatataatttacgttgtaaatataaagtttcaggggtggtatatggacagtcttctttacgaccattatattctaatgaaatagttccaatataaccagtattacaatatcttgacatcgcatctttgatcattgaagctacaatagtttttccactactacctgtaaccccaataattttcattttattactaggattatcataaaagatattagaaacacgatttaactcctctaacgtattatctaccaaaatataaataattttatcatgataatatggcaaagtttttgaataaacaattacttttgctccttgaaaaatagcatcttcaacatatcgatgtccatcaacacttaatccttcaatacaaaagaaaattgaatatggtttaacataacgcgaatcactatgaattgaatatattttcatatcattatcaatatcatataattcatttaaacgtttcattaacctgcacttccttccaatattccatcatatttatcaattttgatatcaacgatttcaccaattaaatcagcatctgtcttaactttcaccttcaaataatcacttgcatgaccaatcaaataatcaccttcacgtttttcaaacaataccttgagtgatttacctatttgttttaaagcaaaatttcgatttaactctttagacagctctaacagacgatttgttcgttcatgttttatttgatcctttacctgatctttcattttagctgctggtgtatttttacgtggtgaatacggaaaaacatgtaattcactataattaacttttttaataaaattgtatgtctgttcaaattcttcatcagtttcacctggaaaaccaacaattacatcagtagtaaaagcaatatttggtaaataacttcgtattttattaattttttctaaatattgagctgttgtatatttacgattcatccgctttaaagttgcatcacatccagattgcaaaggaacatgtaaatgatccacaattatttcatttgaaccaattaaatcaatgatctcatcactgatctggctagtttcaatcgaagaaattcttaaacgtttaagtccttcgatttttactaaatcaactaacaaatcataaaaactatacccctgcagatcttcgccatagccagcagtatgaattccagtcaaaacaatttcaacatagccgttagctactaaacgtttggcctgatttaaaacactatctttatctcgggaacgaactcgaccacgagcatagggaataatacagtatgtacaaaaattattacacccatcttgaatctttaaaaaagctcgggtatttttaaaacgatcaatattcaagtcttcaaactttcttaaattcattacactatcaacttttattaccatctgaccagtttttatatattcatccacatatttaacaatatcttttcgatattgcgtacctaaaacaacccctaccccttcgatctgtcttatttcttcaggagctatttgactgtaacagcctactacacatatcgtagcctggggatttttacgaattgccttacggatcatctgtcgcgatttactatctccggtattagtaaccgtacatgtatttataacataaacatctgcaacttctttaaaatcaacttcttgataatcagcttcgttaaatatttttaacatcgcatttgattcatatgtatttactttacaacctaatgtatggaacgctactgttttcatctattcaccttatcctatttttttgataattttcttataagttttttcaccaataaatttatgttcatataaatattctaaaatttctgtatcatttttttgattaattatttttgtcataacatccttgattaattgtagatcgggatattcttgggtatatttatcgatcaaacaaatttcattaactagttttttattattaaattgataaactactttgaagtcatcgtgataaaaataatcattttctaagtcgtgaccaactaactgtaaagtagaaaaatctgatttatatggctgcattccatataatttaataaagatatcgatttctttggaaaaattttttatataagatttgtgatgctttaatgtcaccagcaaataatcgttaagatagtatttgtttataaatgattctaaataaggtatataaatgttttctccactatcaatatctttaaaattaactaatgaagctgttactttctccatatcataaaaaaatattttttgtctttgctcatagcttatatgttcaaataaatcataattattagttacaaatttattataacattcattgatcgttcttttagcccttattccttttaaaatgacttcatacgcaaacaaatcccaaggattttttactttataatcaaatccttcatcgatgatttctttacttccatcattaacaaaacaaaataaattagttttattcaatttcacttcataacgatacttatataacaattctaatatcttcatttaccaatctccctagcataaccaattatgcttaacatatacaagggcgctgtttcacttcgcaaaattctttttcctaaagaacatgaactgattttcaacgcttccatcatttcaatttctttttcttcaaaaccgccttcactacctacaataattgttattttatcattagattccaatttatccaagcattgttttaaagctaaatgctctcctcttttggctttttcttcataagcgactaaattatatgtccctaaatactcactgatttcagctaatttaatgacattgacaatttggggaatcttatttcttcttgactgctgagcagcctctttcaatattttttgataacgcgccagctttttttcaaactttattttatctgtcttaactacacaacgctgcgttaataaaggaactatccgactcacacccaattctgttgccttttgtaaaaccagttcaaatttatcaccctttggtaaagcataaattaacgttatttctacatccagttcattattttcgtctatttctttgataattttaatcgatccttgttcaacctcatcgatcatacaagaatatacttgtccatttatatcaatacaagtgatttcatcaccatttctacttctcatcacattttttaaatgatgtaaatcatcagcagataaaatcaaattttttttattttttaaatcttcatttataaaatatcgctgcataacaatcctccggtaccattctaacatgaaatcacgactgagaaaagtaataaacgatatcgattaataatcatccaaattactttgatcataataaaagcaagtacctaaatacttacttttaccatttaaatttctttactattttatctatatactgattggctatactataaaatgtttgatgtttataaacctttttagaaaaagattttccatattcatgatttaaacaatatccaaaataaataacattagaaatcaagtaaatagaaatcaacattactaccaaactagccaatggtccatataatgtattatagcgactataatgttcaacaacataaaaaaaacctcccccgatcaagacaatacaactgcttgtaaacacagaaccaatgagaccatatgaaagaggtcttttttcaaatgataaataacgataaaaataataaaaaacgatcaataatcctagtaccattataactggtttattaattaaaataatatagtttataaaaatcaaaccagcaatagctaaaatcattaaaacaaatagaacaaccgctttgattctcaataaaatcatataagtatcgaattcttcgtctgtttttgaaatcaacataaatgaataaaaagcattgctcgctagataaattgaaaaacttgttgaaattatcaaagacgtaaaatccccatactcctgagataaaatatattcaataaatggagctaaaatcatctctggaatataatcatacaacaaatcaattaaattcggtgaatttaaaatatcattttgaaaaattcttaaaaatataattaaagtaggcagcaaagctaatagtatacaaaagctcaatgaatagcgtgataaattaccttggggtgaaatgaatttcaatattacattataaaatcttctcatatgtcaccttcctactataattgttaacgataaatttaagaacatactaaaacatcaaataaaaagaggtaaatactacctcaatttactataatttatcattatactctttcattaatttataatacaattcttctctacgaccattttttaaattccgattttttcttacatgatcaactaaagtatgttccatataaacatagatcaagccttcctgctcactcatttcattaacctgcatgccccatggatcaaataaaacactatgaccaacataactttcatttggatcatggccaacacgattcacccctaaaacataacattgattttcaattgcacgagctttcaacaatgttatccaatgttcatctctttctttaggccaagacgcaattacaacgatcatatcactgtttttagatgctaattgaaagatttctggaaatcttaaatcataacaaacaaaaccactaatattatatccattaatattacaataaggaatttcattaccacaatgataataatttctttcttttaaaaatggatgaattttatcatatctaagtaattctttctgaccatcaactgctattaaactattataatataaatcattttttttactaattgcaccataaataattttaataaaatatttttgtgataattctttaaaaaaatcatcgatactttcatcatacatttctttacatttcattgtaaatcccgttaaggtcatttctggaaaaacaattaaatcagcatgatttaatttagcaaccttaataatatcttttacttcttttttatttgtttctatatcttcaaaagacatatcaaattgtgatattgcaattttcatattcatcactcccatctttttttattattataacaaattattattagtttgttaaatgttttattacataaaaaaactagtaaaatgtaattcctatctattataagataagaatacatttactagttatctattaacttaataatttaaaaccattatcatagtctacggttacgctactaccattcttgatcgttcctttaatcatttcacgagcaattaaagtttcaatattagactgaataaatctctttaatggacgcgctccaaatgttatatcataaccttgttcactaattacggctttagcacgatcactaacagaaatgacaatctttttatcacttaaacgatctgataattgcttaataaatttatcaattattttattaacaacactttgatcaagtgagttaaagtaaacgatctcatcgatacgatttaaaaattcaggtttaaaatgagctttcaattcactgtcaacagcatttctagtatcctcgttattaccttcaagtaaataattagaaccgatatttgaagtcatgataataatcgtatttttaaaacttactagatttcctttagaatcagtgatccgaccatcatccaatacttgcaatagaatattaaacacttccacatgagctttttcaatctcatctaataaaacgatgctgtatggatgccgacgtactgcttctgttaattgtccaccttcttcatatcctacatatcctggtggcgctccaaccaatctagacacactgaatttttccatgtattctgacatatcaatacgaacaatatttctttcagtatcaaacaattgttcagctaatgatttagcaacttcagttttaccaacacctgtaggccctaggaataaaaagcttccaattggtcgattttcatcattgataccagcccgtgatctaagtatcgcatcagttactttttcaatcgcatcatcttgaccaataactcttacttttaacgcttcatctaatcgtagtagtttttcacgctctgattccattaatttattaacaggaattcctgtccagcgcgcaatcacttcacttactgtttcaaccgttactttttcttgtaatagatcatcttcttgttttgaagcttcaaactgctggatttctttttcaatttgcggtaatgtctgatatttaattttagaagcttcttctaaattaccctcagtttgatatttttcctttaatgcttctaaacgaactttttgatcttttaattcttttacatgatctaaagattttttctcttctttccacttatcacttaatcctttaacttgttcatccaatgaagctattcgtgccttaatttcatttaaacgtttttcattatcatcatttttatcttctttttcaattgaaatacgttccatttctaatcgattcttctcacgcgtaataacatctagttcttctggcaaagaatcaatttccattctaattgaagcacacgcttcatcaattaaatcaattgctttatctggtaaaaaacgatctgtaatataacgctgtgacatatttactgccccaataatcgcactatcagtaatctgaacaccatgatgtgattcaaatgaatcttttaatccacgcaaaatagcaattgtatcatcctggtctggttcatcaacctgaactttttgaaaacgtcgttctaaggcagcatctttttcaatatacatacgatattcatctaaagtagtagctccaatacagtgcagttcaccacgagctaacattggttttaacaaattggctgcatccattgcaccatcagttttaccagcaccaactaattgatgaatttcatcgatgaataaaataatttcaccttcagcttttttaatctcatttaaaacagcttttaatctttcttcaaactcaccacgatatttagctccggctactaaagcacctaaatcaagttcatataaagtcttattttgtaaagaaacaggaacgtcatttttgaaaattcgccacgctaaaccttctacgattgccgttttaccaacaccaggttctccaattaagattggattattctttgtttttcgtgacaaaatttgaattacccgacgaatttcctcatcacgaccaataaccggatcaagtttaccatcagcgacatccttagttaaatcacgaccatacttttctaatacttcgtactgattttcaggattttggttattaaccatattatcacctcgcatttcatcaataactttcttaacatcttttcgattcaaatgatattcatttaataaatctttgatccatgagctattcaattcaaataatgccataatcaagtgttcaacactcaaatactcatctttaaatttatgcatctgtttatcagataaatttattaactgatttaaatcataagaaattcgaatactatttatatctacattactaacgaccggtttactttgaagtctgtttaacaacttattttgcaaactagtaatatcaacattacttcttgataaaacacgatataaaataccagcactatcttccaataacgctaataaaaaatgttctacatctactacttgatgacccttttcactagccatcgtaattgctttttggattgcttcttgcattttagcagtccatttttcaatattcatgtccatcactcctttagcactcctcttccctaagtgctaactatattatatactttattttagcactgtcaacccctgagtgctaatttcttgatatttttttccctgtaaaaccaaaggtttgcaatgcactctaaatccgtaaaaatatctttcaatatagcactccaatcttatctttagttatagaaaaagcagtcaacaagtgatcaactgcttattttcataaaacatgtatttttattgtcattgccttgtgtgtttattttgtatactcactgtatcatagactctaagcacaaacaatcttctccattgatctagtctgttttatatctgaatttttatatttaaaaatttattatattcattataaattattgaaatgcaaaacttggcacaaataaaaaagcacaatcataaatttgaataatttatgattgtacctttaaaaacaaaattactatttaattattttccaaaatatctttcaagtaatccttgtaatgcttttccatgtctagcttcatctctagccatttcatgaactgtatcatgaatagcatctaagttatttttcttagcacaagttgctaaatcaactttaccagctgttgctccgaattcacaatcaacacgccaagctaaattatctttagttgttgctttcatatttggttctagatcttcacctaataattctgcaaatttagcagcatgttctgcttcttcataagcagctttttcccaatataaaccaatttcaggataaccttctctatgagcaattcttgccatacataaatacatacctacttctgaacattcaccttcaaaattagcttttaattgttcaaagatatattttttatcttcttcagaaatatcaggattattttttactgtttttgcataaataccataatcatgttctgcagcaagtttcatttcaccttctacttttttaaacttatctgcaccaacatgacatacaggacattctgcaggagcagcatctccttcataaacataaccacatactgaacatacaaatttagccattataattttcctccacattcataagttagttattagtaattatcagtaataattactaatattagtatatcctgttttcaaaaaaagtcaatactaaaatacctatttcctttgtagtttaatactttatttagttacacacaagaatatttaaatattttttatacatttattaacttcataaattaaacggttatgaatatacataaccgtttaaaattttaacattcctctttcttacgacaaacccataaaccagctaaacctaacactgttaatcccattaatggttctaagctaatagtatcaccagtagctacacttgctgttttatcaccggcttttactgaattatttgcttctaatccggccattgcttttgttaatacttctttagcattatctacttctgcctgggttgcttctggatcatttaatactgctttggcttcatctaatgcttctgccaccactgaccatgatttagcactgtaatttgccgcatttaagctatttgctttattgatcaattcttgtaatagatccttatttggaatcaatcttaagtctaagtatgctctgatcaatgcttcatatgcattatctactgcttcttgggtcgcatttggatcttctaatacggctttagcatttgccattggttctactaagttagcaacacttccttctgtatatagactcttatctaagccatttaccatgtcatatgcttcttgtaatcttgttttatcaactctgattactaagtttccaattgcatcttttaagttatttaatacttctactacttcatattctaatgcattttcatcattcatgacttcaattgctgcatctaaggcttctttgaatgctgtccatgaagctggggtgtagttttcttctacataattatttgcttcattgatcaaggcttctaaagcactcttatcaccttttacaaattccaacatatgaattgctgttgataaacgtgtaaatgatgcatcaattactacttgactagcatttacatcggctaaaatagtttgagcttcttctaaagcggcattaaattcattaactaccgctggtacaacattatctaaagctccttgagcttttaatgtattagccgtatctaccgctatttgtaatgctgttttatctgtttgtggtatttcaatttcttctagattatttacagcatcctgtaaatcagttaatgccatatctaattctttttgggtactgttgttattagctaatatagtgtttgctacgcctaatttttggatgaataattgatatgattcaactgtatatcgatcttctacaatatctaatccagcaatatatgattgtagatcgttacgatttggtaaatgatcttcactgtttaacatgattacttcagaaatcataggaacattatttgcttcccactcaaattttaattcataaatatttgaccagaatggtaaataaatttcatttaacgatttactcaaagtaccagcttgtacccattctctaccattttcaccatcaactaatattaatactttagcgttagaaatacttcctttttgaataatattaatttttgtaacatctaaattttctgataatgtatagctaatataaccagcatcatcagtatctggtctatatgctgtagctaaattaccatcaaacatattttgtggtatgtatccttgtttttcaattacacttgcatcaaaagttggatcatttgatactgaaacatattcaccatcattaactacaatttcattaaatacaactgcacgattattattagtggcagtaattaaaatcttaatataacgtgctgttatattatctgctgttccctctacatatactttatttggatatgtactagatgccttatatccagcatctgaatttaagcaggtaacattagcatcatcttcattttcaattccatcaccaatcgtaataactttagtccagttttctaaatcatttgaaatcaaaatatcagcatcacgaatataattaactgctgaatcctggcagtacattgctagtttgttaattattctttcttgacctagatcataaataatatattgccctttttgtggtaagtcagcaaattcagttatcgtatctacatttccatcaaatgctgcaccattatcacgacaatcttctgatacaccccaagatgaattaataccaatatcactatctaataaaaatggtcctgataattcatttgaaaccacttcaaatttagtaattccaaaagtaattggttcattagtattattgatcaatcttacataacgtgcatcaggcaaatctgtactcttagcatcaacatctacccaatcaacataatttttagatacttgtaatgttaaagcatcaccatttactaattgtagatcgatattagctaaatctctaattcttggtaatgtaataccaatatactcattgctatttaatacgatcgtatctactggtgctactaatgcactattagtgtcaattgttgtagcaacattttttagatcttcattattcgtatctacaaatgtatcgcttggtttattaactctaaaatcagacatttttaaccaaacacctttgtcttgggtgtttctaactcgcacataacgtgctttaataccggttaaatctgcttccactgttttcttttcaacgttttgagtataacttgcaaaaacagtatagttagtaccatcacttgaatattctaaatcataggcattccaataatcagtaccagagttacccatgataaatctaactttaccaagtggtaaaacagaacctagatctaaaccaacataatcgccagcttgactattttgattaaaccatgtaaaagtgctgtcatcatcatctatcaagttagcagtaccataagttgaataaattccatatcgatcaactttaataacactagcattatatttttcacttgtatcatctactaaaccttgaccattaactacaatatcacgaacacctaaccaagtatttgttttatcagtagttgcaatcattctaattgcttttacattatgtaaatttaaatcagttaaactgatttcctgtggtaaatcatattcttcaccatttacatcctgccattctttaccatctgtagtatattctagtttagcttttaagaatgtatcatttagatttccactttgtcctaacctaaatgttactgaatcaacatctttagctctactatagctaataccaacatatgtaccagtagtaattgtatttggtgttttataaatcacctcagtgcttgcattattatctaatgcattatctaatgcaccagttggtgtatctgtacgatttgtaataaaagaaacaacctcttgatcaggattaacaatcgtacttacttttgttgacaaaataatatctaaattttgcatgaatgggtaaatatatcttctacctacttttgcatattcagtatgatctacatagaagaatccatgggttctagaagcatcgaattcagcttgaccagctgcaaaataatcccatattacactgccctcttcatcattttgtaatgatttagcagcatttaaataattaataattgattctgttgtttcttgccaacaatctaaccaataaataatttgatctcttgttctttcatttccaggattattacgatatgtattagcactatcctgtaataatttaaattcagcaattaaatcatcagcttgagctaaaatatcattaccagcattcaaatcattgataaaactagataatttatcttttaaatcaactgattcttcattaccaatttgctgtgaattcatcatatgtttactcaattcacgtaatgcaattgaagcaggcgtatcatcaattgttccatgatccatataattaaatgaatcatgccatacttgatcatatttacttgcctcttcccaaatattccatgcataatcagcattagtaaacaatgcttctttactaggttctgactgttgcattggatttaaaacaattccttcaacagttgatggatcaacattaggttttaaaactgcttcagctccacccataattaaaccatcttttgtattatcgctacatggccagttgatccacatataagcaggacgtcccatattttgatagaatctatcattgaagcttggccctacttcaccccaaactctaccaccagtttgaataatacttactgaatctggcagttgtttcaaagtttgcatctgtgtacttgaaccatatcccatatagtcatttgggcaaaaaatcgtatctgattttaatcctgatacagttgcttgtttttcaattagccattcagttaagtcactcattaaacgaacgtaacattgtgccccttgtgatggaacagaagcatcatctgctaaaattgcaaattgctttactccaactgacattaactgttcaaatttagtttttataatatttaaatctgtttcataattttcatcagtattaaaacgaattgcattatacataaatggatgtaatgcataaacatagtaacatttacttttattacctgcttctgccaatttgctaatgccaactaattcttcatctgtatataaagctttccaatttgaattatgcttaggatcatctttaggagcataaatatattgatttaacttataatctccaccaaatgtcatcaaatccgcacgatcttcatttgaccaaggatttccataatacccttcgataaatccacgtccttttacatcagcataatcattgatctttacatttaaaatattattatctttaacttggttaaaaatatgttttaatgatgtcaatccgtggaaagcagcatcagtatctttacctagtactgcaataacaccattattgatatctaaaatataagaatcatagttggtaaataaatcctcactatcgattaaactgttgcttttaaaataactgtctacataatcatttgaattatatgtcccaataatcaaatttgttttatttgcatcgatagtttcgctgattgtatatgttttatttaatatacttaatatatcagcagcatgatctttagtaaaactatcaattgcatcaccatacaccacatttacatcattagaaattgaaaagctatcatcgctatatatcatttcttgaggagttggatatattgtgtagtttgaaatttcttctgcatttactgaatttaacataactaatgaactaaaagtcatcgataatgttaaagcaactgttaacactttttttaatgtttttttcatctcgttctcctttctcgtataactttaaatcaattagatttccacgttcactaataatttaagtttacgtattgcatagaacactactacaaataaagaccaaataccgatacaccaaaaagcatatccagcatctggtcttgcctacttaaagtaacaatcctatcgcacttctattatatcattgcataaatctctgtcaaccgtttttactaaatataaacttgtattttaattttatttagttaattttaactaaaaatcagtatttttttaatatgaatacataggtaagtctgctcatcaggtgacaaaatataatcataacgatctttgattaattttactattctattaatacataaagctaatcgtgcattttctttaagcatatcacgaatatctgatgttgtatcctcaaagttgacttcttcatttctaaaaattctttcagctaaatattttaaatgaatcgaaattcttgcataaccaatagaatcttcttctaactctattttcatagttgttttaattaaatttaaaacttcctttgtcaaagtaactattctaattgcattatttgccttatcattaaacgaaaaattgactaaatgcaaagctaaatatccagcttcatcatcatctaatcgaattcctatttttctttcaatatagtcaagagcccataatccaacttgaaattcttttttataaagcgtttttgtctcatttaaaattatattcggtaaataaacatgttctttttttcgcttaacagcaaaagagaggtgatcacttatagcgataaaaatttcaccactaaaatctgtttctagatctttgcttgctttagcaactatcttattggcaatttcaaaataaacagcaggtacttcagcaattgactgttcaaaacgcttcttttgctcatctttaaataaatatgttttttctattttagattcatccactaagtcccctatcttcttttgaaacccaataccagaacccgttaaaataatatcgcctaattcatccgaaattgcagctatgctgttattgttaaaaacttttaatattttcaactctgccacctctttctacatcaatatatcgttgattgaatcaacaataaatcctacttctgttcccataataatttgaatactatttttattaactttaactattcccgctgcaccggtcgctaaaatctgttgttcatcaattatatcagcatcttttaattctattcttaagcgcgtaatacaactatcaacaaaaatcacattactgcggccacctaatgcctctaatatcaaaatagctatttcatcataatcctgatttaccaatgtgaccccatattcttcttcatccacctcaataactatatcctcaatttctctacctggggtcataagatcataacgaataatcaaaaatctaaaaatacagtaataaattaaaccgcagactaatcctaaaggtatcaacataaaaatatcatttgcaaatggcgattttatacttaatatataatcaatcaatcccgccgaaaaaccaaatcccgctatccattgaaaagaggcagctacaaacatcattattcccgttaaaacagcatgaattatataaagaatcggagctacaaacataaacgaaaactctaatggttccgtcacccctgttaaaaaagaagcaaatgcggcagataataaaatcgatcccacttgttttttcttttctggtcgtgcacattgatatatcgcgattccagctgctggaagaccaaacatcattactggaaaaaagccagcctgatacatccctgttatcccacggacaccaccagatatcgttccccaaaacttaccaatatcatcaatccctgcactatcaaaccagaatactgaatttagtgcatgatgtaatcccgttgaaactaaaaggcgattaaaaaaaccatataatccagcaccagctggtcctaatcctgatattgctttacctagtcccataaatatgctgtataaaaacggccaaatgattatcaatagtgctgatattattaacatcataaatgtcgatataatcggaacaaaacgctttccactaaaaaaagataaggccaatggtaatttagtctttgaaaaatgctgataattaaaagcaaccagcagacctacaattatcccaactaaagtattagctgtatttttaaaagctagaggcactttttctactgcaatattcctaattaaagcaacagattctggagataatattttcaccacaatcaaataacagacaactgcacaaattgctactgtcatgtctttttcacgagtcatcccaatcgcaataccaactgcaaacagtaacggtaaattatcaattatcgctgtaccagactctattaaaaatgccgcaatccaattattacttccccaaccaactggatcgatccaatatccgatcccttttaataacgctgctatcggcattactgataccggtaacattaaagattttcctaaacgttgaatatagctcatcatttccctaccttattataaactaatcgtcccaaaataaaatattgcagatttgtcacctctgcacctttctaaaattataacctttaatatcaaaatatgtcaactaaaacaataattcaaacaagtaacatccttaaatgttaataataatgtttcatatatttaacttgatatacaaaattgagttgacattattaaaattacaaggtagaatctaattgtgatgttactattaaattaggcattagcagttattcttgacagctaatgccttttaatatttataaaggaggaacgaaacagaatgctttttatttcaaaaatcataacttcaaataaaaaaaatcatatatgtgcacctgttagtggtaaaatcattcatttacaaaatgttcctgacaaagctttctctaataaactaattggtgatggactagcaattgaagtatcttcaaactgtatttgtgcaccttgccaaggaaaaattagtgtaattgccccaacaaaacacgcttttggaattttaaccccagatggagtagaaatactagtgcatatcggtattcaatcgctcaagcctaatgcagccaactacgattatcaaatcaaagttggtgatcttgtaaaagttggaactcctattgttacattgagcgaagaattgttaaaaaaacataattataaaattatcacacctattgtaatatgtaatcattacagccatcctattaaagctatgaccaccgcctcctcaatcaaagcaggtaaaactatctacacttatcgataataaaaaagggacaaaataaattttgtccacctgggtgatagtgcattttaaatgcctttcatcctttttggtattataatgattttaggagatgactttatgatcgatttatctgttccttctgatacattaggtctttttaattttaagcagtttgttaaaaaagacggtaaaaatacttttaaatatatcttctttgacaattacgactatatcattaatctacatgataaaggcaaactcagggatgtttcttttgataatgttcaaaaaactatcctttgttcttctatccatcttggttatgatctctttgtctgtcctaactgcggcaatgaaactattgttgctcatacctgcagttccagatactgtaccaaatgtggttctaaatccagtcaaagacgcgctgcttatgtcagctctatggcttttaaatccaaacatcgtcatatcgtctttaccatccctgctcagcttcgcttctactttatcaaaaaccgatcactgcttgatggtctttttgtcgttgccagaaatactctggcttcccttttcaacgacagaaaatatcgcagacaaaagcgtcttgaaaaaaagaaaggtatcttctatcataaaaaaagcaataaatctcaatatctttacaaagatacaactgataatgtgatctttggtgccattgcctcattgcacacttttggcagacctcttgactggaatccgcatatccatgttctggtatgcgaagatgcttatgattctaaagataacaaaatcaaaaacttcagttatatggactataaaaaacttcgccagacatggcgttatcaattactcagctatcttgacagacacattggcaacgacaaagaatttcaaagccttaaaagctggttctaccgaaaatacgaggaagggttctatgtctatgctccaaaaatcaaagatgaacagactaaggacgacattgaaaaatgtgttcaatatataacccgttataccagcagaccaataatggctgaaagcaggatagtaaactatgatgatgataagaaaatgattcattggttctatcatcgtcatgaagataataagcgtgtagatgtcacagaatctgtttacagttttcttaacaaggtattgatgcactgtcctgaaaagaacttcaagatggtaagatattttggtttttattcaaataaatcaataaagacctataacaggatggctgaactgttgagccataaacaaaaaagagtagaagaactaaaaaatgacagaagggtgatgatagaaaagagacaaaaagagttacatttcagatataatatgataaaatcatttcaacgggatccattgctttgtgaatgtggagaaacaatggaatataaagaaagctatgaaccatttggtggaaacgataaaaatgacagagaatatcgtgaccgaaagattctcaaagcaaaatacagctatgagcataggaagaaggtaaacaagtgatcaatctgaccgatgaagaactagcagaattattaggggaaccagaggtaatgataccgatgaaatgtaagagatgtggttatgaagaagaagtaccggaatggatactagaagagtttttaggtgaagaaatatattcaggtaaagagaatcaaggatacagctgtcagtgtccaaaatgcaatggaagaatggttaggaaaaaatgatatttctaacacttttttagccacataaaaatatccagccaataaatgtacccttatgattggatatttttattttatacctaaacgaatcgaaattcctattagaaaattaaaagattctggcaacagaatcttttaatttaaacacctttaaacttatttaattattttttaaatatcagacttatctcgagatctaattaaaataatggtctcactattagtaacatatgcaaaatcttcaatcgtttgattcgatacacatagtggatcatcatgttttaaataataattatgtaaaggataatgtgcatgctcgatatcaatataactatcttttaaagcaaataatgaaaaatatttatagccatcattcataattttatgtttacctggttttaaaagctcaattatattttgactatcaataactctgatttttacactttgatatttttccaataaacacattacactaaaaaaatgatctaggcgacctcctgtcacaccataaatatcaatttcatcataaccttgtaaaagagcgtattccaatgccgcatgactatcggtaacatcttttcttgttggcaaacgctctatttttaatttcgttaataaattctgattttctattgaatcaaaatcaccgattgcataaattggtttgatcccttgcttaattaaaatctcaacaccacgatcaacacctatataatttaacgaatgatcaagttctttagctaaagcactacaaattcctattttcattttaatgattcaatcgcctttgcataatcatcactattaaaaatatagctgccggcaacaagaacatcggctcctgcctgacgacattgttttgcggtaatttcatttattccaccatctacttcaattaaataatggtactgatgatccttttttaattttgctaaattagatattttatcaagtgcaataggattaaatttctgcccaccaaagcctggttcaactgacattaccagtactaaatctaattttgataaaaaaggtagtatctcttctactggcgtatcgggtttaatcgaaattcccacatcaacattttgatttttaatataatctattaaactatttatttcttctttaacgaccgcttcataatgaaaaacaatcaaagatgctttactagcaataaaattatcaacatattttgctggttcactaatcatcaaatgaacatctaaatacatatctgtgattttgcttacatcatttaaaatactgtaaccaaacgaaatattagggacaaaatgtccatccatcacatcataatgaatccattgagctgtttctattttgttaatttcatcttttaaacaagtaaaatctgctgataataatgaaggtgctattttaaccatacttatgttcctctttcttttttgtatcttgtaaattcattagataatgctcgtagcgttctttagaaatcacgccatcaactaccgcctgctttacgccacaattaggttcactatcatgcaaacagcctctaaacttacatttatgactatactcttcaaaatcatgatatgcaacagctaattcttctggttttatatttaaatctatcgaagaaaaacctggtgtatcaccaatatatccatcatacattttaatcaactcaacatgtcttgtagtatgttttccacgtcctaatgatttagaaataatatttgtctctaaattcaaattaatatccaaagcatttaataaactgcttttccccactccactttgaccagtaattaccgttattttatctttgaacacagtttttaattccataattcctacattgtctttcgaacttatttcataaacgcgataccccgctttacgataatccgcaatatatttttttacttctttatcacctaaatctatcttggatataacgattattggttcaatctgcaaatgttcaaccactaatagaaatttatctaataacatcgaagaaaaatctggttctttacatgaactaacaattaaagcctgatcaacattacaaattggtgggcgaattaaaaaattttttctcggcaataatttcataatatagttatcttgatattcaacataatcaccaacaaggggcttaatttcgtccttgcgaaatttaccccttgcccgacattgaattattttatcaccatcttcaacataataaaaccctgataacgccttaattattctaccttgtgacattaatttcctccttaatcatctgtagaaatttccggttttgaatcataataatataatgtaacggtttcaccatttttatcaactgtactaaaagcctctggactttgtcttatcactcgattaatagcaatatttttaatttcatcttcactcaatgaatcagttgataatttgctgagaacaacattaaagtttttactctccaaacgacttttagcaacattgatttccattcctacaacattaggaacttctattttaagaccacctgaaactgtcaatgtaattgttctatcagtttcatcaggatccactttatgacctttttgcaaactttgttttattactgttccctgaggcttttcagattcttctgtctcttcaattacttcaaatcctagttttgccaaagcctctttagctttttcaatatccattcctaaataatctgaaataactatataattacctttagaaaccgttaacgtaatttcacgttttttctcagtaggatctactttttcaccttcatcaatactttgttcgattacagtacctttagtttttgaagaaatctcatattcaatagtcacatcaaatcctaatttatctaatgccttttcagctttttcaacatccattcctacataatcatcaacaacaatatatttacctttagatattgttaacttaacaacatccccttcttttattgttgttccttttttaggatctgtttcaataatcttaccttcatcatactcatcagacaattcttcaataatatcatcactaatagttactttgtaatctttcaacagttcttgagcctgctcctgcgtttttccctcgagatcaggcattaaatttgtatctggccggatattaacataaagtgcaaatgcaattacagcaacaacaaatactgtaccaataataattgcagctttagccttagtacttaatcccttaaattttgtaactaattttttcaatcctttttcttctttagccttatcctcttttattacttcttttaccggaggaatatccgctgtatttccggtattaaatacagaacgagaatcaagaactatcgtaggttccggttcactatcataagtaaatttaagtttttcctcatttaaacgatccatacaagtattaaggtcttccagcatttcatttgcattattatatcgatcattcaaattcttagcagttgctttaataattatattttcaactgattgcggaattgaaggattaaattctaataacgaaggtagatcttcctgcatatgtttcaaagcaatatttactggagattcaccgttaaaaggaacttcaccacgtaacagttcataaaaaacgattcctaaagcataaatatcactttgtactgttgctttttcaccacgtgccagctctggtgccaaataatgtaaagatcccataattacatccgtttgtgtcacttgcgctaacgactgcatagatgcaattccaaaatctgcaatcttagctacaccactatcagtcactaaaatattttgcggttttaaatcacgatgaatgattcctaactgatgtgccttagcaattccactaactacctgtttcataatatctattgcttctacaacatgcacagcaccacgctttaaaatcaactcttttaaagttgttccagggatatattccataacaatataatatttgtcttcatcttcaccgacatcatatatctcaactatatttcgatgtgaaagtgctgctgcggcactagcttcacgttgaaatcttgttacataaataggatctttagctaaacttgttctaagaattttaatcgcgatcgtccgatttaaaataatatctttagctaaataaacatccgccataccaccttgaccaataagctctaataattcataacgttctgcaattatttttgacatcctatttacctcccctattatcaataatagctacagcaatattatcataaccaccattttcattagccaaatcaattaattcatctaccatataaggaacctttatatcttttctcaatacttcaattattttattttcatcaagactgttatataagccatcactacaaagtaataataaactatttacaaaatccaattcgatcaatgaaggttctattttagtatcggcaccgattgcctgcatcaaaacatgtttttgactatgattttttccttcttcttcactaatcacgccacgtttgatcaattcattaactaaagtatgatctctagttacctgaattaaattatcatttttcaaaacatatgcacgactatcgccaacatgagatatatataacatattgtccataaaaactgccacaacaattgtcgtccccataccacgatgttcaatattttgcatcgctgtttttttcacaataatatcagcctcaattatcgtttcctttatccatttttttacctcatcaacattatcaaacggcggaatacaattaaaacagcttaccacatgttcaattactactctcgaagctatttctcccgaacggtgaccacccatcccatcacaaacaactgcaacgatttgatcttttgtattaacgattactgctgcttgatcctggtttttacttcttaccttaccgatatcagtttttgcataatagttcattatttcacctcacttcttttagcccttaactgtccacaagcaccatcgatatcgcgcccatgttcttttcgcatcgttacatttatatgtaatctaagtaattcgcttttaaatatttcggcctgctctttagaactaggctgatagccatgttcatcaacactattataaggaatcaagttaacataagcatttaatcctcttaaataatgagcaagctgacgagcatagataatatcatcattgatatctttcaacaaaatatattcaaaagtaacccgccgattagttttattaatataatcactaactgcttttcgtaaatcatccatcggatatactttatttattggcattaattgattacgaatttcatcatttggagcatgtaaagaaatcgctaaattagtttgaataccttcatcactatatttattaataccatcaattaaaccacaagtagaaattgtaatatgtcgtgctccgattgctagaccatggggatgattgatgattctcacaaaactcatcacattatcataattatcaaacggttccccagtacccattacgaccacatggcttattcgctgtgctatatcctgctggaccttcatgatttgagcaaccatttctcccgctgtcaaatttcgctgtttattaagcagtccgctggcacaaaatttacatttcatgttgcagcctacctgacttgttacacataaagacttaccataatcatgaaccattaatactgattcaatcaaacttccgtctaataattcaaacaaatacttaattgttccgtccttagatatttgtttttctttgatttttaaaacatcaaatctaaattcttctttcaaattatttctaagttcttttgataaatctgacatttcatcaaattgataagcatctttttgataaagccagctaaacacttgttttgctctaaatggcttttgctttattaaagcaaaatattcagttaactgttctaaagaataatcataaatatttttcatcttattttcctttttctaatttacacatataaaaaccatcactatcataaacatatggcaaaatcttcttttcttcaattatccgcatatctggatatttatcaagaaattgttttatcattagttcattttcttttttatttatagtacaagtactgtataccattttaccattatttttcaataaatagtaggcattgtctaataattttgtttgtaaagggatcagcgtatccatcactgtagaatcatgatatttaatttctggttttcttttcattactcctaaaccgctgcatggcgcatctaataaaatcctatcaaacgtttcttttggataatcatctttcaaagttgtcgcatctttgacatgcagttctacattagttatccccaaccgtactaaattatcattaactaatttgattttatgttcaaacaaatcataagcaatgatcttgccactgttttccatcaatgccgctaaatgagctgttttactgccaggagcacagcacatatccaatatcaactcatttttttgcggatttaataacggcgctacaagctggctggattcatcttgaatcgtcactgatccatttttaaaatattctgtatccgcaatatttccagcctcatataaaacagcatctaaagctagatttccctttttaaaagtgctgtctttcaatagctcttctctatttatttttagtgtattgactctcgctgctcttactggtggcatattatcatgaaaacaaatcttttttgtcacttctaaaccgtattgtttacttaacatttttaccatccacaaaggatgactggtttcaattgataatcgttttaattcatcgacttcatcaatatttcttttaccgtttcgaagatagtttctaagaatggcattaacaaatttaccagcatataaatttttatttttagccagtttcacagcctcatcaataattgcatatgatggtattttatctaaaaatatcaattgatataatgacatcaacaaaatcaatctttcccgatttttaactttcttgcccttaatatacggttctaattgatattccagatatattttattttgaatcgtcccatacactattcgtgtcgctaaatctttatcatttcttgataaatcactattttgtaaatattcgttcaaagttatatttaaataactctgttcattccaatattttaataaaacttctaatgcaactgctcttgccataaatttcctttctacatttgactatagggattaaaatcacacacaacatttattttagtcccatttttattataaaatttgctcatcttttccaatactggatatatttccttactattaataaactttatcatgattcgtttgcgataaatatcatgcatccgataaattaaactatttgctggtcctaaaatcattactttacttaactgcttttgtaaataagttttaatttgatcagcactttgaattactatggattcatcatgtccctgaatcaagatactaactaaatgaacatatggcgggtaatgagccattttccgaaaattcatttcttctttaaaaaaacctagataatcatgattttttacacattgtgagacaaagtgttccggattataggtttgaatcaagaccgttcctctttttcgcccacgtccacttcttccagatacttgttccaacagttgaaaagttctttcattagccctaaagtcaggaatatttaggcttatgtccgcatctaaaaccccaacaaacgtaacattttcaaaatccaggcctttagctatcatctgtgttcctaataaaatattgccttcttttctcgcaaatttttctaataacttatgatgtccatctttattcctggtagtatccacatcatagcgaattacttttgctttagtaaaagcagcttccaactgttcttcaaccttttgggttccaattcctacaggttttaagtaatgacttttacaattaggacagcttgcaggcatatccatttgatactcacaataatgacattttaatttgtgatcatgcttatgatatgtcaaagtcacatcacaatgaggacattttatcacttctttgcaatcaagacaacgaatatatgtggcataaccacgtttatttaataaaagaataacttgttcttgattatccaaacaattctcaattctttttttcatttctctagaaaacaaagaataatttttatctctgatttctttagccatatctactaattcaatttcaggtaacggaaattgattgattcgtttaggcaaattataaagatcataaacaccctttaaagctcggctatatgattccaatgagggagtagcacttcctaaaacaactggacaatgatgatattgtccacgcaacctggcaatttgaatcgtttgatagcgcggtttagtttcttgtttataactaggatcatgttcttcatcaagaatgatcaaaccaattttatttaaaggtgcaaatactgcacttcttgccccaacgacgatttttacttcattatttaaaattcttcgatactcatcatacctttctccagaagaaagtttagaatgaatgatagctacttttttaccaaagcgctgtttaaaaacatcgaccatcattggtgtcaaagaaatttctggaaccagcattaaaactgtcttcccttgattgattacatattttgataaatgtaaatatacttctgttttccccgaaccggttacgccatgaattaatgcagtatgaaaaaaatcacttttggcgataatgccgtcaacgattttttgttgatctaaattcaaagaaaattcagtctctttttctatttttccagaataaggatctcgaaaaatttctttatcaataatttgtacagcttgttgttcgactaatttattaagtaatcctcgactatatggaaaatcttttaaagttgtatcgttgttttcttttaaataagcaagagcttctttttgcttaggtgttttaacatcttcattaatgactttgatcaccttttgatatttaatcccgacacttttattagtacttggttttagctgagctggtaacattgcttgtaaacaactgattcgcggtgctaaagtcaatttagctaaagtaagtgataattcttgtaactcttgatttaacagcggcttttcatcaataatttcacttatataacgatatttaaatcctgcttcctgttccaattcacttttagttaattcactataatgagatgccattacatatccaattattttttgagccccaaaagtaatcgcaacccgcacaccagttaatattttagttttagataaataatcaaaagttgtatctaaagcatgagttggatgttcgactaatacttctacaatatacactgttatcatctccgtttttcctattctatcataaaacaaaagagacttcatcatcaaagtctctataaactaaattctatccttatttaaaatctaataatatcctttaaacatattacgatacatgatcaaattagtcgatatatgcagccatagcacccttataactccataaccctttggcctacaagctacaaccatcgcataatttaatttaaatttacgcgcataatgatcagctttgcgtaaatgccagctgttagtaatgactaaacagctattaaaatttttttctttcattatttcactagcatacattaagttatgatatgtgcatttagcttttgattctttaataattgcgtttttatcaactcctaatttaaaagcgtatttttccattacatccgcttctttgtatcgattttggacgtcagctcccgaaaagataatgtatttgatttttccctgccgatataattcaaccgctttttcaactcttgacttcattatcaatgaaggtttgccatcttgatttgcgggaaaaccacaaacaattgcacaatcgtattttgattgcttttgtttttttaatggctttttaaacataagtaaaaatagtcctatattaataaacccaaaacaaaaaatcacttttttaaacattattctactttctccttatatttccctagaaatattacaaaaagggaatcaatgtccctttttcttagccttacgtttttcttgttttaattgaaacaaataatctttcttatctctcttcaatttctttttactaactctactttcattcttattttgctcatattgcatctttaaagcctgcattgactttgttccaatagcaagatcagaactttgctttttgattattcttaacatccgtttaggatttttcggtctagactttactttcaactgacaaaccgctttaaaagataaattttgactgtgatataaaatataattatagacttcaccatctttaggctcattaccaaaaacaactctttcaacaaatctttcacaatcaccatttaaataaaaaaccccgatccaaaacggatcttcaaaaaacacatctaattccataaagcttcctccttaaaataatatcaaagaaaggacaacctaaggaggcaggttactggcaactaacagctgcgtctggactaccaaccagactgtgtttttatctttgtaattttattgtactaaactactttccaatagtacagttttttattatttttaaaaccctttttataaaatttcaacatcttgtaaaacactaaatttctatacataataaataaaaggtgtaagtaatgccaaaagaattagtactatataatgactttaaaaatgatatcttattcaaattcctgctctatttaaacaaaacaggaaatgtatataaaagatattattacaagtgatgaaaactagatatcatcattaaataaaagcagttaaaaaaggtgattacaaacagtttagataaagaatagattatttaaaaagaacagatgagtaaatctgttcttttcgattaaatcaaaaatcatttttcaaatttatttaaaagataacatccactatataaaatcaaccaaacaattcctacaaataacaaattaatacttacctcattattaagataaaaataaatttttaattgatcatacaaattcatcaaaaacactaaaacaacgataatgatgagcataaccggtaattttattttaccatcgttctttttcaacattctaaatgcttttttatcaaaaatcttaaaagcatctaacaacaaatatattattaaaataaatatcattaaaactagatctgtaggacaaaaaattaaattcaatcccaatttcccttccactacttgtgcaaaatataaaatgaaaacaactccaggataaaaaatatatgtaaacagcctaaaatattcttttattttttccatctttcctccactaaaaatcagggattagtaaccctgattagttcgatgttctttaattatttttgcaattttttcttttgcttcaataatatcatcattttcaacaacatacttatactcatctttagtagctatttcttttcttgccttagctaaacgctgctgaacgatctcttcttcttctgttcttcgcccccggatccttctttcaagttcttccatacttggtggtacaataaaaatcgtcgtagcatcaggacatctttccataacttgaagagctccctgaacttcaatttctaacactacatttttcccttcacttagcagctgatcaacataatctttaggggttccataataattccctacaaactgtgcccattctaataatttaccttcactaactttctttttaaactcttcttcttctacaaaaaaataatcaattccatctctttcgttgggacgtggtttacgagttgtcatcgagatcgaatacgccaaattcaaactatcatctttaaacaattcttctcttactgttcctttacctactccacttggaccactaagaattattaacattcctttttgcacttattaacaccccttttttatgatatgttcatcatacaaaatacaccttataatgtcaattgttttcaatctatgttatactattttgggtgataaaaatggcttatgatggaataatgatgcatcaagtaataaacaaattgaataacacaataacaggtggtagaatcaataaaatctaccaaatttctaaatacgaattgttaatccaaataagaagtaatcgacaaaattataaattacttctctcttgtcatcctatgtatgcaagaattcaactaacaaatttagattatccaactccggaaaaccctaatcctttaacaatgttatttagaaaacatctagaaggcggctatatcaaagagatcaaacagatagaactcgaccgtatttgtcacattctttttggctgtcataatgaatttggcgattatatagaatatcattgttttattgaaataatgggtaaacattctaatattattctttgtaatcaggataaaaaaattcttgattgtttaaaaagaattactcctaatattaatagtgaacgttttgttcagccaggtgcaatctatcaactacctccagtaaatttcaataaactaaatccttttgatcaagatttcattgaatgtaataatttaactaaagtctatcaaggtatttcgccaattctttccaaagaaatcctttatcgtcatgataatggcgctagttttatatcaatcatgaatgagatcaaaaccagtgaacaattatatataagtaaaacagatcaaaaagaatattttcacttaattcctctaacccatctacaaacttcatttcaagtataccctttatttgaaggtctcgatcagcatttcaatctaatcgatcaaaaagagcgaattaagcagcaaacttctaatttacttaaattcattacaaatgaatatcaaaagaacatctctaaattaactaaactacaaacaacgttagaagattctcaaaatagtgatgaatatcgaattattggtgatttattatattctaatttacatttattaaaaaaaggaatgaaacatattgaattggataattattatgataatactaaaattatggtcgatttagatgaaaaacttgatcctaaagcaaatgctcaaaaatattataataaatatcaaaaagctaaaaattcaatcaatgttttaaaagaacaaataaatataactcaaaaagaaattgaatattttgatagtttattaactttaatggataatgcatcatactatgatgcattagaaataaaagaagagttagaaaatttgggatatttaaaaaagaaaaagaagcataatactattcgtaaaaacaaaaaacctgcttttgaaacatactatactaaagatggaattgaaatatgtattggtaaaaacaatctccaaaatgattatttaacattcaaacatgctcatcgctatgatacctggtttcatgtcaaagacatgcctggaagtcatgtgatcgttaaaggcgataaattagatgaatatactattcgtttagccagcaatattgctgcctattattctaaaggtaaaaacagtagtagtgtgccggtaaattatactttagtaaaaaccttaaaaaaacctaataaagctaaacctggccaggttattttagatagttataagactatttatattgatcctgatgctaattgtttaaatgaattaaagaaaaaatagatgccttagcatctatcttttctaacgattacaaccacaaccacttcctgtattatttgtagtgttgtacattccgttgattacagaatccccagtagtattattatatccgctattattaaaaccaaatgtagatgccatattagcatttgtaaatggatttccagcactttgagtcatacaagtgcgttcatagcgtggataataacgtgggtaataaacgatattattaacatgacggcattcgattggacaaataataggttgctcaacatattgattagagcatgttgtacaaacttttcgaggagctacgattggtgttgcacgacatccattcatagaattgttccatccccaattgttgcagctattacagctgttacatccacatcctgaattactaaacatcattttcacctcctttaatatactatatgtttaattaaatttggtgctaaggcaaattacataggaaaggataaaaatatgaaattaattaaatggaatactgtaaaaaatattgaagcgtatactgtaactaaaaaattaggagatatgtcttttaataatgttgataaagagttaatactaaataaccgtaaaaatctggctgctcttttaaatactgatctagaccatatggtagcaccacatcaagtacattctgcaaactttaaagaagtaactattcatgatgggggtaaaggaatttatgatcaagaaagtgcttttgacaacactgatgctctttacactaaagatgctgatctatttttattatcatttcatgctgactgtacccctgttctattatattctccagaaacaaatatcattgccgcaattcattctggatggttaggaacaactaaacaaatcgtttctaaagttactagtcatttgatcaataatgaacattgtaaccctaaaacaatgttggcatatattggtccttgcatttgtcaagattgccttgaagttatggataatgttatcgatcttgttaaagcgatggattttgatactacaccttactaccataaaactgatgaaactcattatttaatggacaataaaggtcttaataaaaaaatgctcttaaatctcggcttacttgaagataatattactgtctctccatactgtacagttgaaaatgacgatttattttatagttaccgaaaaaataaagatagtggtagaaatattactattattaaaagatgttctgataaataactaaagactcaaaaagatgatttaattttattaatccaataatcttaaatcatctttttattttcagatataaactatttttgttcattaataatttcatgcatcactttaggaattagattaattagtttactaggaattacagtatatgaattatccccaataatatcaccacagctgccatgtaaatatgttcctaaaatagctgcatctttaggtaaatatccttgtccaacaaaacttgtgattattcctgccaagacatcacccattcccgcagtagccatcgctttattcgctgtaatattacgatatacttcatttccatctgtaataatcgtatttggtcctttcaacactacgatcactccatattctgatgcaaactgagaaactttttcaaccatctctaattcatcattataaaagcataaccgtttaaattcaccatgatgaggtgtcaaaatgattggcatagaacaactttttaataaatcaagatgcttagaaacaatcgttaaagcatccccatcaatcactaaaggacattttacattttttaatgtatcaattacatatcgctcgctttgctcatttaaccccaaaccagagccgatcaaaacagcatcacgattttcaaaaacatttacatctaaaatttcttctctaagtaacgatgtgcattctggcgtagtacttgcaagagcatcaataactttatcactagagcaaacgcaaactatgccacttccgctaaatactgctgctcgtgacgctaataacgccgccccacgataatgatcacatcctgtaatctgcaatacttttccatagatacctttatgtccataataactgcgtggttttaagtgatatttgatccacgatggactcactagtttagctaattttaattcatggcgtaaatcttttacatctaataattcaatcgcaatttcaccggtatacatatgacattcatcatttaaaaacgcctgcttaattgctgtaagagtaactgttttactggcacaaactacactaccataagggattccggtatcaggatctaacccagtaggaatatcgattgcaataatatcaacatcatataaattattaatttcattaactaatatttttgcgattcctctaacctcactatttaacccaaaaccaaacattgcatctactactacatctgcttttttagcatctcttacaaacaatgaaatatcctcttcatccataaaggttatcggtacttccatttcctgcgcttgatcgatataataattattcgctcttgataacttatctggatttccaaaacaatataatttaacatttcttgctctaagatgtaactttatccccagactcaaaccatcagcaccattatttccaggaccacaaacaatcacaatattatcataatttttacaatggggtaaaatagcattactagctttatcaactagttcttcaattgtataaccagcatctaataatgctttgtcgtaagctttcatttgcctacttgttgcaacatacatatcatcaccaatactttctactaaattttatgtattaattataaaacaaacagacaaaaaagcctacccatttattcaaaataaaaaggaatctattaagattcctcaatatattcaatttttattttactctgatggcacaaacaaaacctgaacctgaaaccgatgaaattttaactacatcacctgtttgaggtgcatggatatacttcccaccaccaatataaatacctacatggccagatttccataaaatatcacctggttctgcagctgaaacactgatttgagttcccgcactcttttgagctgaagatgaatgtggtagtgatattcctactttagaataacaccatttaacaaatcctgaacagtcaaaagcattaggtcctgcagctccccatttataaggcgctccaagtttagagtaagcagcagatactaccgcatttccataagcattgcttgcagcactacctgtatatactttattaatttttacagttaaagaagcactactactattacctgcttcatcacttacagtatatgtagctgttttattaccagctttatcagtacttggtgcagaaatttctactttagatcttatatcaccatctttattgtcaattgctgaaacaagataagaactaaagtcaacgttatcaccagcatttataacaatatttgattcacttaaagtaattactggtgctgataaatctttaacaacaacatttaacgcactttcagtagtatttcctgaactgtcttgaacagataattttaatgtttgcacttcatccatttttaaagtatcgattgaaccttcaacatttggtgttaatgctccatccaaattatctacaacacttacatagttatttaaatcaaatgtactaccataatcaacagtaacattttcaccttgtaataaattaattactggtgcttctaaatcacttactgcaaaagtaaatgttttacttgctgtatttccagaactgtcagcgacattcaaagtaatatcctggaaacctggtacatctgtatttagcggcatgtttgcctcgataaatggagttacatcaccatcaacattatcagtagctttaacataacttgcaaaatcactacttccttttactggaacttcaataacataacctttacttgttcccagcatctcaaacttaggttcttctttatcaacaacagcaactttaattgtttttgtcgccacattagaaccttgatcggtagcagtaactccaacatcatatacgcctaactgatttacattcaatgaagatgtatctgcttttacatcaattaattcacgactatctttattgtcgacaatatcaatactatctaaatctaatttctctccgtatggaacttcaatttgattagatctaatttccggcatttctttatcggttgcagcataacctacaagcataaaacttgcaacagccacaatcggaatgaacattgctttacgattaacaatatactcatcaaacacatttgttagcttcgtcttaatatttatatccattcgttacctcctttcaataatatatccatgtctaattatattactatttatcttaaaaatccacctatgaaagcattttcatttctgccgttttttcaaaacctaagcctggcttaggtttcagagaaaaaatttttttaaattttctttagaatttcttaagattttatatactcctaaataataattcttataaccataaagaatttaattactcaatactttttaaagactcaaccatatcaatgcgatttaaaactttacgcattacaaaattaataaatgacgtaaaaaacatcgtaattactattgcatatatataactcattaaatttacacttctaacgaacattgcaacttctacttcgaccgttgtaataataaacatatgaatcaacttaccaagtcctaagcctacaaaagatccaatcagtcctaaaatacgattttctctaaatacataatcgtatacttcttttggataaaatcctaatactttaattgtcgcaatttcacttttacgttcctgaatattaatattcgttaaattatataacacaataaaggccaaagccccagcacaaacaatcaaaataacaacaacactatcaatacttcccatttgatctctaaatccttgcgagattccttgaatataattaactgaatcaatatttgtatcctgattacaatattcactaattctatcttcattagttttatcttttaaattaaagtaagtataattcttatttacctgctcacccgttaatttttgataaaactgatcagtcatataaatatgatgttgaaagtgtaataccattaccccgctaacttttacttgatagttttgatcatcaattttaagtgtaattttatctccagccactacttttaataattctgaaagtttagctgaaataattactccatcattattcaatttcaattcatcatgagtatcaaaatcctcaaatttaatatatttacttaattcttgattactattaaatacttctaaagtaccataatattctttatcatccaaaacactgatcgtctttcgataaaaactacagctatctttaacattacttacatcattaaaagcggcctgttcctgcttcaattctgactgattcaaattcttatcaaaaacaacaactccatcataaacccatatattaccgtactgcttatcggcaagggtggaaattgaatttttaattccaaatccaactactattaaagctgtacatccagcaattccaatgatagacataaagaaacgttttttatatctaaaaatatttcgcatcgtcaccttttggttaaaagacagtcttttccaaataaaagtaattctttctaaaattatcctcttaccaatttttgggggtttaggccgtaataaattcgaaggagtttcatttaattcctgacgtactacgatataagtgacaatcattgtaattgcaaccgaaatcacaaatgtttgcacacagataaaagcgctaaatcttactattattggtgctccaacactaaataacattttatgatacaagaaataaattattcctgggaaaaaatatacaccaaggaccattcctaaaacactagcaaagaaagtcgctaaaaaggaatagataagatactgattaataacatcttttttatcatatcctaaggctctaaatgtaccactttgaattcgctgttcttcaaccattcgtgtcattgtagtaagactcactaaagcggctactaaaaagaaaattaatggaaatacgacagctaaagcggccattgatttacaggcagaatcaaaacttaatatacttgcattttcatctctagttaatgttattaattcacttttcggaatatctttgagactatcatgaccttcatctaatttttgctttgcttcatctaactgtactcgagcattatctaaatctatttttgtttgatctaataaaattttcgtatcatctaaagtttttttagaattatctaattcttgtttagatgactttaaaataacctctgtgctatcaagcttagctttactttcatctaaagtttttttagtattttctaataaaatcctgttttgttctaaaacattcttattttcatctaactcaattttacttttatctaattcttgttttagattagtactcgttgtatctaaaatctctaatttttctttcgtttgatctaaaaatgttttcaattcagttagctgtccttcaggaattcccgcattaatagcatcattatactcatttaatttttgctgatacacttgattcaattgctgatattgacttatcaactgattatactgctccatacctgcctgccactcaactaacccttgatcatattgactttttccttcaagataagcctgccagccttgatcatattgagcttttccagcattatactgatttaagccatcctgatattgttgatagccttcattatattgcgtcaaaccttcttgatattgacgatatccatcttgatacttggctaaaccatcattatactggttgattccatcagcatactgtttctctccttcagatagatccttttcaccttcatcaatttcctcattagcattctcaacaagttcatcatctatttgtgttatttcttgatctaatactttttttatttgtttatcaactttttttgtataatcaagatattcatcactaaatacactatcgttgtctggattttttaacgttattcttagctcattaaaaatttctgtgcctcgtaaatcatatagttcttgaggctgcgctatggtttcatttcccttggataatatttctacataaccatcattcgttccgtctcctaaggtatttgtcccacgttcaatattactaacataacgacaatcattaacaaaaccactaactataaattctttagaaccattatcattagataaaataattttatcaccaatattcactttattctttaaagtaaaattataatcaattacacattcatcatctttatccggcagtttcccttcaacaacttctaatttatttactttattatcaaaatttttattagaataaacagtaactcctttactattatcattaaattctatcagtgcatcaaaacgatttccatattcaacagcctttacctcatcaatagccaatattttttcaataacatcttcatcaaaccctaaagtattaatataattcaaatcattatattcatatttctttaaataatcatccattgtagtttccatgatcaatgaagtatgccgtaatcccgcaaaaaaggctgctcctaaaaaaacaatacaaaaaatagataaaaatcttgctttagttttacgaataatttgaatttgattttttacatacgctctttttttcatattaccactcaatttctgctatcggtttaggattttcatttagactcatcgatgctacctgcccatttttcagatgaatgatccgatctgccattggtgccaaagcactattatgagtaatgacgatcactgtcatcgtatatttatcacacatctctcttaacaagcctaaaattgctttaccggtttggtaatctaaagcccctgttggttcatcacacaacaataatttaggatttttagcgatagctcttgcaatcgccactcgctgttgttcaccacctgataattgggctggaaagttattagttctatcttccaaaccaactctttttaacaccatttttacatctaaaggattttttgatatttgtgttgccagctcaacattttcaagagctgttaaattttgaactaaattataaaattgaaaaacaaacccgatatcatctctacgatattgtgtcaactgtttttcatcatatgctgcaacatctttaccatcaacaatgattttgccactagtagccttatccattccaccaagcaaatttaaaatcgtcgtttttccagctcctgaaggtcctacaataacaacaaactcacctttttcaatcttaaaatcaacaccatttgatgcattgatctcaacatcaccaactttgtatattttttttacgttttcaaaaacaatgaagcttttcactagcatcactacctttctttttcgacattataattataacatgaaataattattgtttaaagaaaccaactttggatcaatttttatttttataggaattttaacatttaaatgttaaaattatattaatgaagcgttttcttaataattttgttgattgatatcaaatcataacaattaccaatgcttttaataactacataaggagatacaaaatgaagataatgatcttgtctgattctcacacaatgcctaaagaggatctaataactttgcttaaacatagccgtgctgactattatatacactgtggtgatatttatacatcctatgacggccttggtttaaataatttttatttagttagaggaaataatgattttaatagaaacattcatgatgaaatatttattactattgataatctcaaattttttgttacacacggtcatcattacaacgttgactatgaccttgacaatctttttaatactggtgagaaaaaaggtgccgatgtcatatgttttggacatacccacagtccttttatcattaataaaaacaacatcaccatgatcaatcccggtagtgtctgttattcacggggaaaatatcgtgccccaacttattgcatctacgatacccgaaataaaaaaactgttttttatgatgtcactacccttaaaccatgtaatccttttagcacttcaaaaaaagaaccattttttaaaaaatggttcaaataatcaatactcctgcaattcctttttcaaatcctcaatataacgttcttcaaatttatcaacattcataaatttacctaaaaatgatcgaggttcaaaataaaacaacaagtacaatctacaaccaccatttttcaacggtgcaaactgcccacaccaatgtccttgataattatcattttgaacattatattcaagctgaatatttttatgataatcagttattttaattttagtattcctgcctttgcgatcatattctatatattcattatcactgattttttccacttttgataaatcactacgccaagaacaatcgctcatattggttacagtttcaaacactttttcaacattacttttaaaatcaactgtcatctccacacgtttcatttttatccctccaaaaatcatagtttacatcaatttcattataacatattcacatctttaaaagtgttcactatgataaaaagactgttggatccaacagtctttttattatttttctaatgcttttttagcagtgttgacaatttcagtaaatccttttggatcacaaattgcaacttctgataacattttacggttaatttcaacgttagctaattttaatccgtgcattaatttagaatatgagatattatttaatcttgcagctgcattaatacgagcgatccataattttctcatatctctttttacttgtcttctatctctatatgaataagctaatgaatgcataacttgttcatgtgctgttttatataatgtatgtttagaaccaaaatatcctttggctaattttaatactttttttcttctacgtcttgtagtaaatccaccttttactcttgccatttatatattcctcctatttaaaactatttacataatcttgatttaattctcttataatcagaagcatgtactagagttgctttagctaaatgtttcttttgtttatgagttttgttatgagataagtgtgatacgtaagcatgactacgttttaatttaccactacctgttctttttaaacgtttttttagaccactatgtgatttcatttttggcataataaattcctcctaaattattttttctttggcgcaattattgcagttaaagttctaccctcaagcttagctggtttttcaatctgaccaacctcagcacactcagctacgaagtcatcaataacttttttaccaagatccatatgagctaattgacgtcctctaaatctaattgccaccttaactttattaccttcttctaaccattttaacgttctctttaattttacattcttatcatgaacatcaatagttacagataattgtgtttcttttaatgcaacaacttttgaatttcgtttcatttctttagctttcttttgttgttcaaagcgatatttaccaaagtccatgatccgacataccggcggttttgcatttggtgcaacacacactaaatcaagaccttcgttataagcaatatcaatcgcttgattacgagacttcactcctaattgatcaccattttgatcaattactaaaacttctttgaaacgaattttctcgtttaccaactcatctggttgttttggttttctgttatcaaatctgctaataaaagccacctccattttagtagtttaaataaaaagtgagcacactaagcgcccacacatattgacaataagataattatcttagtgacatttgcctatcgacatcatcaatcaggcgagaagcaggcacttcttctttccactacttttcattttcttgtatagaatagcattttaattcaataaagtcaataatattttaaaatttattcatcttcttttatttgtaaatatttaaatgcccctatgactgtaaatcctaataaaaccataattgtaaacatcctatcaccattatattatatgttcaattattcgttttattcctatttataaactaaacattttttaaaaacttccggcattgctgctttaaactccatttttacctttgtatcaggatgtacaaatgcaaatacatgactgtgcaatcccatcctttttaatggattagttgcagcaccatattttttatcaccaacgatgctatgtcctaaatactgcatatgtactctaatctgatttttacgtcctgtatctaagaaaatttccagcagcgaattataacgagactcttttaaaacttgataattagtaattgctagtttcccttttctatgattagaaacatagaccatctgtgttttactttcatctaaataattttttatttgacctttctttttatctaatttaccttcaacgattgccagataaccacgtttatatacaatctcattccagttgttttgcagtttatttttgattatttcgtttttagcaaacatcaaaacacctgatgtatctttatctaaacgatgaacaacaaatacttttgccttgttatttttactcttcaaatattcaccaactaaatgatatgcggttttctctttttcatttccaccagcaatacttaacaatcccgaaggcttattaattacaattaattcatcatcttcataaagaatatctaaatttgtttttgaaaaactacctttactaacaacaatttcatcacctttttttaattgataattaaattggctcgttactattccatttactttaacctgcttatattttaataaatttttagcgttcttcctactataatgattcaacaaaaattcaattaataaaatatctttttcaatcagatatttattcatttatttcttccgcctttactgccatcccagaaacttgacattcaatcatattattacccaaattagttgtcgtaaagcgaacattaacgattgctgttgcatgtcttctcaaagcatgttcaactattattgatgttgcttcttgtctagtaatatctaataattgttcaatatttgtattatcatcagtttctaaagccttattcatcactttactgccaaatacaattcctaaatttttagttattttataacctggtaaataatccattgtacatatttcaaccatcttcatacaattctcttccccttatttttatctattcaaagtcagcttaaaacaccctgcttatttcatatcaataattcgatgagtatttaataaaactactatctcctctaccaaataaatcactaatgccagccaccaaggcaatataccttttacagctatcatcatcataataaaattaatcaataatccgacaaatatattttcaaatgtaacttctttttgttttttagatatcataaatgtttcaataaccgtatttaaatccgaattcatcaacataatatcactattttcaataactcttttatcttttataccaccacggctaattcctacatatgctttttgcaacagagcaatatctttagagttatccccaatataagcaactgggccatctactcctgctatttccataatttctaacttctcatccacagttaaattattatggatcttatactgatcatcttccaaatcaaccggaccatcattaaaaataatcaaatctaaacgcaatttagataactcagaaaataaattcatctcctcttcagttacttcagcaccatcaaaacgatcataaataacagttcgacaagagtttaacgcatctagcccactattttcttttattacaatattttttgaaaaagctttagcgactcctgataataccgcaaacgatgaaacttgtttgtaagcaaacgaaccagaaatagtcaataaaatcgttcctaaataaataaacttgaaattattttctagatcaataaatggaatgatcgttgcacaaattattcctgaagcaactaaaaaaacagtatatactttacagatcagctctactattttatgggttctagaagaattaactggtgccatcatcgcaatctctaagatcttgttcatagcactatgatcatatgtatataaaattttgattcgtagagttcccgtaatattaacactaccgctttgaacctcactgccaacagttactttttctaaaatatcattaccgttgatagcaaacatatcaatatcactttcaccagaaataacctttcccccaagaggaattgtttctcctggcataatagtaataatatcaccaatatcaatatcctctaaagaaaccatttcatactcattttcttttatttctcgtcttcctaactgaactggatttatctcattatttatttttcccatcgttaaactgataagatgtaatagtagccgttcacttatttgaaaaatcaatgaaactatcaatgtttcaacataagccccatatacccagccaaataaacaagctaaattaatagttatattttcacttaaaaaatgtttaactttcaaatctttataagctctacgtaaaatattttcattaaaaataatcaatcctactaaccaggcaagatttgttataatacttggatcatttctcgttaccaatcctaaagccagtgcaacaaacaaaacagcaattttaaacattctctttaaatatttttcttgaaacaaatcttgagatttaaacggttttttccattgttccacatctatattaggattaactttatctactaaacgattcaatcttaccaaaatatttttctgactagttgtcactttaagtaatttatttgtaaaatcaagagttacattttcatatgccgaatagcgggaaattacttcctcaatttctttagcttcttcttctgtttccaaattagtaaacataaagatgtattccattttactttccgaagcaacgaattcacgcttacgtgaattgatttcctcttttaatactagatcaggataattatttttcaaaacttcatgaacattatctggattttcacaataaaaagatattcctgttttaccaatcttgattcttgaaacttcttccattccattcaataataaacttatttcatttaatttatgattatcatttatattatcaacatagaaattacgcgccatagtaatctcctttctaattgatttttattttatcatatctattctaaaaagccaaacctatatgtttattccataaacatattttaaaattcggggataaaaaatttcaaattcatcttctgttatcgctttaggataagacattaaatgaaaatataaacagtgtttcaaattacgcaccggcaaaacgcaataatcatattgatcatttaaaacaagtccacatttttgataaaacgctattctccgaatactttgttcatcttcaggatactcaacctctaaaatcaccatcgcatcaaccattgctataaagtgtttcaacattttacttcctaaaccttttcccttatgattaccatcaatagcaaaataatcaataaaaacaaattcattgctaagataataagacaatatcccaatcattttattattatctattaaagtcagtactttaaaggcacctttattaaaagtatccttcatatattcataatccttaatttcttttcttggaaaattatttaaaataatattataaaaatcatcaaaatcctttaattctaaatctttaaagatcatctttttatccctttccttttcatcaatacaaaattttcttcaaattcttctttagtacaagaaagatcaaattcttcaccataaatcttataattgatctgcagttgaccactatccctaatcacacaatcataaatatgccctttggtaaacaaatcccgcttttctttaccaataacgatattcatcgttttaatacagcggcaaactcgccgctttcctatatttgcgatagtaatcacctcttttctcttttattatagcatttctaaaaccaataaaacaataaacataaaaagtctagatgatctagacttttatcatagctaatttttactaaattctaacagctctaaaccagggttcttttcacttgcccagcgtacaccccaatcatttgtaaacaacaataaatattgtccttttaaatcctgaacttttttggtatcactagataaatttaacgaatttaaatcacagcttgcttttacccagcgaatatattgataaggtaaaggctgtttaatgatttcaacattatattcattctttaaacgatactctaatacttcaaattgcagtaccccaactacaccaacgatgatttcttccattccaccacctagttcagtaaaaatctgaattgctccttctttagcaatttgctcaacaccttttacaaactgttttcttttcatcgtgtctttattgcgaatcagcgaaaaatgttcaggtgcaaatgttggtattccttcaaacgcaaattttgctttacccgtagtaatcgtatcaccaatagaaaagattcctggatcaaaaataccaataatatctccagcataggcctcatctacttcctgacgttcatcggccattaactgttttgactgattcaatttaattttacgaccaccttggtaatgataaacttccattcctttagtaaacttaccagaacaaattctaaaaaacgccattcgatcacgatgtgccttgttcatattagcttgaatcttaaaaacaaaagcactgaaatcttcactaaatggatcaattattttttctcccgtactacgtggcaatggtggcgtcgtcatttctaagaaatgttttaaaaatggttcaattccaaaattagttaaggctgaaccaaaacaaaccggtgaaagtttcccctgacgaaccttttctaaatcaaaattattaccagccatatctaataactcaatatcttcttgtaatttattatataactcttcatctaattcattaactaactcaggatcatcaaacttcataactttagtatctacttctttacgtccaccatcaaccggaataaagcggatcacttctttatcgttacgttcatagacccctttgaactcttttcccgaaccgatcggccaattgatagcacatgtgtcaattccaagttcttgttcaatttcttccattaattgatatggatcctgggcttcacgatccattttattaataaaagtaaaaataggaatattacgcatcgtacataccttgaataatttacgtgtctgatcttcgacacctttactagcatcaattaccattactgcacagtctgctgccattaaagtacggtatgtatcttctgaaaagtcctggtgtcctggagtatccaaaatattgatacaaaaaccatcatattcgaattgtaatactgatgatgtaacagaaatccctctttgtttttcaatttccatccagtcactagtagcatgtttactattttttttacctttaacactaccagcttgttggatcgctcctccatataataagaatttttctgttaatgtcgttttccctgcatcaggatgggaaatgattgcaaatgttcttcttttttctacttctttaataaattcactcatcttaatgtctccttgcaaacttaaataatatagattaatcctgattttgtcaacctaaacttgacttcttatcatttaaaacaatatatcaattaaatatatttttttgtagaaagagagtatctaacttattatgatcatataactcaatattcaaaataactaattatttccatttgaatactatttgttgaaaagtaatatgaatatatatttttatatgacaatcatccatgctataataaaataagtgaggtacaatatgtttataagacaagaagagataaaagattataaaattgtatattccgtgataaaaaaagcctttagttgtgctcaacacacagatggaaatgagcataatttagtagatgcattaagaagcagtaaagcttttattcccgaattatctttagttgctgaaataaatggaaagatcgtcggacatataatgtttacaaaggcaaatattgataataatgtagttttagcattagctccattatctgttttacctgaatatcaaaaaaaaggtgtaggaactgctttgatcaaagaaggacataaaattgcgaaaaaattaggttatggatattcaatcgtattaggcagtgagaaatattattcaaaaacaggttatttaccagcaaatagatttggtataaaaccatcttttgatgtaccagaagaaaattttatggtttataaaataaacaaagatgcttttaatattcatggaattgtcaagtatgcaaaagaatttggaatttaataattaaaaaaatgatttctacaaacattaaattttaggtttcccagtgataaaaagcactaaacatttttaatgttatataatatcaaaaataggcaaaatatctgcctatttttttacttatataaacactattatttaagatccatgctatttaaaaagcaaaatttcctgcttcaaaaataattacttcctgatcatcattggtttttccaatgattcttagatcttttgtcccaatcataaaatctacatgtgttaaagaatcgttaacccctttttctaacagctgttctttagtcattgttaaaccatctttaagacattcgctaaaacctttaccaatcgccaaatgacaagaagcattttcatcaaacaaagtattgtagaataatgtcttcatatttgatattggtgaatcataaggaaccaacgctatctcccctaaataatgactaccttcatctatttctatcacttcttttaaaacttctttaccaatcttagcatcataatctatgatccgaccatctttaaataccaatttaaactcttcaattaaattcccattataattaagcggtaaagagctatatacgacaccatttgttcctttataattaggacttgtaaaaatttcttcagttggcatatttgcaaagaaataaacaccatcaacagtatatgaaccaccaccagcaaataaataacctttatttaaacttactgttaaatttgttcctaatgaattagtataaaccaaactttttaaattaagctgatttaaataatcaactcttctttcaaaactttttcgatgttcatcccaagcagcaaccggatcatcacaatcaactttcaccgctttaaaaatagcattccataaagcttctaaagcctcactatctgacatatctggatacactttattagcccacttcaacgaactagctgccacaatacaccaagtattgacccctagatccaaactatcataaaacggtttacaagcagtcgctacacttttagaccataaagctatctttaccggatcaattcctttaagaccttcaggatcatcgctatgaatagttaaaaaggcagcattttgagcagcataatcatttctaaattccttaaaccaggctggtactttaccaaattcatcttttgttacatattcatatttataacgtgatactatttcatcatgatatttgaccacaacttccttggcaccagcttcataagcttgttttgtaattaatctaactaattcagcactttcaaccggagcatcaattactactatttggtttttttgaacgtttaatcccgactttacaattaatttagcatatttcaataacttttctttaaatgacatattattccctttctatatttatattttattaatcatattttaccactattttcagcctttaacaaaataataccgcactactttaatttattcaactcatcaatagcatcaagcgatcctaaatcagctgctttttgataatactttaaacctctttcaagatctttttcgattccatcaccataatagcacatatagccagccataaaactcgcttcacgataatctaactcactagctcgacagaacaattcaaaagcctcctgcttattaatgcttgttccaatcccataaaaatagcatcgtcctaaattataaattcctggtgcataattattacttgctgcttttaaatagcaattaaacgcctcattgaaatttttttctgtacctattccattttccaaataaataccgtacatatttaatgctggtacatattcataattagaagctatctgtaaatatgtaaaagctttttttacatctctaaaaactacttttccttcatctaaatataaagccattcgatacatcgctctaatgtcattttgatttatcgccatcttataataagtaatagcttttaaatcatcatgatatgcaggaacctgttcataaatcagccctaaattatacattgctgccacataattcaaatctgctgcctgctgataaaaatcaatagctttttcaagatcaatttttcttccctttccttcttcatacgctaatccaacatgatataatccaggagcataattagccttagcagcctgcatatataaatcaaaagcatactgatgatcgcattttactccttcaccatgatcgtaaagataacctaaattacacaacgctcttggataacctgcttcactagctaaacgataataataaacagccgcctttaaatcaactgcagttccaattcccatttcataacaatatgctaaattacactgtgccgcaggataatttaatttagccgcctcaccatataatttaacagctaactctaaattttttttcactccaaaaccactttcataacaatatccaagtgctaccatagcctgaacatccttttgtttacacgcttgacgataccaatatgtacagcgataagcagcattttttatttccggatgattttcataaaaatagcctaaccaaaattgccctcgtgcataattcaaatgagctgcttgtttataatagcgacgcgctttttttaaatccatagcgactccctgccccaattcaaaacaagtcgccaacgatactaatgctggaggataattattttcacttgcctggtaataccagtaaacagctttaacaaaatcctgttttgttcctagcgcactttcataacaatgacctaagcgatactgcgactgtacatgtccttgattagccgcttgttcataacatttgaatgctcttttatcatctttatcaattccttcaccaaattcaagacatgttcctaaactatataaagcttcactatatccaagtttagctgctttaagataatactctactgcctgatgcaaatctgctttaacaccgcgaccatactcatagcagtaacctaaattacatatcgctctaggaaaatctgccttggcaccttgaagatacaaattaaaagctttttgataatcctgctcaacacctattccaaattcataaaagtaagccaaattacaaatagcaacaacattattataacttgctgctttttgataataatgtgctgccagcgtatcacttggttcaagacccaaacctcgttcatacatatatccaataacacagatacagtcactgttatcaagttcttcacctttttcaaaatattttaaagcttcttgatactcatgacgatcaaatagttttaatccgatcttatataataatctaccgcttaaatcatcaagttcacctgcaatatcttcatcttcttccatcaatatacatagatctataccaatgatatccccttgattattctcaattaaatattgctcatattcaaaaaaatcattttgtaacgacttttgattatctttaaaattatttctaatatcttctactcttttttctaattcttttatattatcattttgatcatacacagttatcacatttaaataagcggttcttttttcattagcatatgactgatgctttaattttatcaaacattcttgattatatacatctattatttcatcaaaaagccattgatcaaacaaaggctcataactttttattcgatcctttatatccataattacctccatatctataaacaaataagcagatatcaccaatctgcttaactcccattaattatattcgatatttcttttgaatatttacccaaaatagcactaactttatttgttgtctgaacaatccctgacgcacctacagcctttaatttttccaaactaacaagactatcatcctttacaaaaaaagtaattttagaagacgtcgcaactgtctctttaatattagttcgaccgcctacagcttccataatcatatttatatctacaggaatatcacttgctttaacttgttttggctgtttattttttatgacttttaaaaagataacagctagaacaattaccacaattaaagcaacaattccgtaaaataaataatcattcattaacatctaccccctattaattattatttaattatagtatactatatcaagatagaaaaaactatcttttttataaggagggattttgtggaagaaaaagagaaatccgtaatttgctggtccttgattggtttattattattactttgttttattagctgtctaggaattaaaagtgcaactccattaattactaaaggaaatcccagcacctactggttaaaacaacttatattttatggaatatcttttatattaatgattgttgtctttaaaatatcaaacgatcgtatttattcctctatgtggatcatatacggcattttggtagttttactcgtcggcctggctatagaacactttttgttcacccattttggaattagagtaattcctctagctaaatacaccggtggcgcaacatcctggtacaaattacccggttttgatctccagccttcggaatttatgaaaatcattttagtggttgtcatggctgatattattgataaacataacaataaatatcttgttcacaatttacataatgactgtttattaattggtaagattttagctgtttccatgccgccatgtatcttagtttatttacaaaatgatgcaggggtcacaatgatcatgctagcctcagttgtctttattatgtttatgtcaggaatccaagccggctggtttgttattggaggaatagtggtcgctattattattgggatcatggtttatattttcctatatgaacatgagttatttgttagtctaatgggtggcgatcataaattaggacgtttttatggctggatcgatcctgaaggaacttatggtgatcaaggttatcagttgtttaatgctttattatcttatggtactgctggtttatggggccatggaatggaaacggcattagttaatttaccagaagcccaaactgactttatctttgcaataattgccttaagctttggtttttttggtggtggtcttacaattttaatcatctgtatatttgatatattattgattagaattggttttagagcaaaaaataatcgtgataaatattttactgctggtatttttggacttctgatctttcaacaggtttggaatattggaatggttcttggacttttcccaattaccggaattaccctgccgtttttatcatatggtggttcatcattgctttcatatatgattgcaatgggaattttcttagatatagaaaagcagactagaataatcgaaggtaagaaaagatattaaaaaaacgctttagcgtttttttattttaacttgttgattagttaaaggatgcaaaaattcaatatatacactatctaaataataacactcaggataagttgaaccatacagactatcaccttttaaaggatatccaagcgaacttagatgcactcttatttgatgggtcctgcctgtttccaaaacacactcgatcaagctcatattatcatatgtttttaaacatcgataataagtaactgcctttttaccatgatcagcaattaatctttttacactattatcatctttgacgattggtttatcaattttcccagtaccagttaaaattccttctaccaaacaatgatacactctttttacttgtttaatatcttttgataatagataatgcgcctgactgtttttagcaaccagcagtaatccttgagtatctttatctaaacgattgaccaaatgaacagtagctttaagattttgctgctggtaataatagatcagagcattagctaatgttttttgcggatagcgtttagtaggaatacaaggtaatccggcaggtttatcaataattagatagtcttcatcttcataaacgatctttaatgaatattcatacggctgcattgaagtagtttcaggcggccagatcaattctattgaatccgctttttttaaacaatagcgaaccgtttgatgttctccatttactaaaatatcacctgtcatcttgattgctttaagtgcttttttgcttaaactttgtttcattaaaaaatctttcaacaaaactccttcatcttctggtttaactataaatctcattcatttataaacgcccttctaattctctggataaacgataattgtcgatattcaataaaattaactgtctgcttagcaattttaacctcaatgctctctacattttcaatcgaataagccaaatgatcgattcctaaataaacatgatcaaaatgatgtcctatcagttttattatcttatcagcatctaaaatcaaacttgaacccaaactgcgataagcattatgctgaattcccgccacttcagtcaactgcatcaatggaactccaggataaataaccgctccgccaatagatttattataagctgttgaacctgagggcgtagagacacatattccgtttcctctaaaaacctctaataattccccattaatataaatatcaattacctgtgttgtataatcgtgatcaattcgcatctcattcaaagccaaataaatatcttcttttccctcgtgtttaacttttacttccaataaattacgaggtgttatccgatattcgtcccgcttgattgcttcaactaattcaaacacttcatctttttgataatctgtaaaaaatcctaatgttcctgtatgtacacctacaaaattaacattctgatctaaatattgatgaatcgacattaacatcgttccatcaccaccaacactaattactaaatcaggattttcttgatcatattccataattccttttaattcatgtttaattttatcggcgacatatttagataaatcgtcttgttttatcactaatgcgtattgtttcattgttttcatcacccctaaagtatatactatatagtatatactaatggaggtcactatggaagaaaacttagaaatagaatttaaaatattaattgataaagatacatatcagcaaattatcaatgatcataaaatagatcgttcttatcaacaaactaattattatttaatgcatcctgtattaagtgaattaaagtactcacttagaattagagaaaaaaataaccagtatgaattaactttaaaacaaccgcaaactaaaggtaatttagaaacaaacctaattataagtaaagagctcaaaaataaaattattgatcatgaattaataaataatgaagtatttgatattttaaaaaaatatcaattagacagtacaatgttcaaaaccgattgttttttaactacacttcgtaaagaaattaaaactcctgaaggtttaatttgtatcgattataatcaatataatggccatgaagactatgaactagaatacgaagtaaatgattatttaagcggtaaacaagcttttttagatttcatccatcaatataacctaacctatcatagcaattgcctcagcaaaataaaccgtcttatcaaatcattataatttaaaagcagtgccttaacactgcttatttttctttaaaatacgcttcattgatcttacatggttgactgataaattgtggacatgcatctctacgaggacattctgctaatttacgaagttctcgtggaataaatactctgatttcttcagcattataacctacttgaaatcttctttcatcaatcatgattggtcgttttaatactgatggattttcttgtataaatttaatcaattcattaactgacatactatcaatatcaatatcattttctttaattatcttgcttcttttagaaatgatatcatctgtcccattttcacttcgctccaataattcctttaattcaacctctctaagcaaggttgaaaaaatatttttttccacatatggaatattatgttctttcagccaagatttaacctttcgacatgatgcacaactaggcgcagtataaatacgaatcataatatcatctcccttactccattattatacattattttaattatttttctatccttttttattttgactttcagttatttagatatttatactattattcaaagcaaaatatcgactatttgtatcatttttttacatttttctatctttctctttttaaagctatcaaatattcaccaactaaaatcatctatattaaaaagaacttagttcaaccaagttcttttatcaattcaattatatcacttttattacatcctaattcacacatctcattaataaatacttttactttttcgttaataatttctgatttcattttttcaattagttctgcatcttcactaacaaaacgtcccattgatcttttactatacaataaattttcacgttcaagttcacttaaagctttttgaatcgtattaggattaacactatactctaacgctaattctctaactgaatcaatcttgacaccagaaccataatatccattaaaaatctttttcttgatttcatccattacttgaatatagattggtaaattaggatcaaaatcatatttcatttagccacctactctacttcgattttatgatcaatcaaatatactgttaaaaaatataaaattgctgcaaatattcctatagtaataatatcaaaaataacactctgtctgtaagttaaactgttaataaaattgttgataggactaagtgtaaaaatatttgcaactactataagacctaataaataaatcacgatccccaatactgttttatatttaggaatatattttgtctttgtaagtgtaattataaaaaagaaagataaaatcatagcgctaatacccacaaaaaagtcaagtaaatgtaaaacaaaatcaccaatattttcactcattatttcaacaacgacatttccacttctaagcagctcagcaaaacttatatcgccaactaaaaaaatcaagatcataaacccaagcaacaaaactaaataacttgcaaaaacccaaattaagcttcctaaatattttgctgcaactaatttattggtactaacaggtaaagtcaatgttaaatatcctggtcttttatacattgaacgattaaaatttaagattacattcacattaatcgctattgaaattcccataaaagcaataataagtaatgtcaataatatcccactaataaaatccggcatccaaggtgttaaagtacacataattaagaaaattgcaaaagttaataaatattgtcggtatgattgaatgatctcatattttaataattttaacatctaaatacctccctgaatgcttcatcaactgattgttttctttgcgatcttaattcctcagtttcttgatgtaaaacaactcttccttcttttaaaaagatcacatcatcaaaaatcgtttctagatcactaattaaatgcgttgagatcaataccagtgaatcagcttcataattatttaagattacatctaagatcacttctctagctgctggatctactcccgcgattggctcatctaaaatatatattttagcttttcgagacattactaaagataattgaaacttttctttcattccttttgacatcgcttttattttcatatttttatctaatttaaaacgattcatcaaagacaagcaattctctttatcaaaatcctcatataaatcactaaaaattcctaatacatctcttacatacatccaatcttgaaaatagttttcatctggtaaataagaaattatttttcttgatttttctccaatcttattaccatcaactaaaatctcaccatcatattcttttaataagccattgataattttaattaaagttgtcttaccagaaccattaggtcctaacaaaccaattattttccctttagataatgttaatgaaacattatctaaagccttaaaatgtccatacttcttactaacattatcaatttttaataattcttccattattatcccctttctgtattaatacaataatacagtaacacaatattatgtcattgtcaaataaaagatagagcaattactctatcttttaacaaactcgttatacaataattcatgaataaaagaatatcccttctccaactttttctttaaccgcaaatacattccaatacttttttcatctttgatctctaattgtttacaaagatctaaaaacttctcataatcttcaacatacaattgatcgatcatattttccacatactgtttttttattcgttcatttcttgttaaaccatattcctttatcaaaccttcatcatacatatgataattgaatactgttagtgactgcgtttttaaatactcgtttattaaagtccgctgattaatcatcggcaacgaacgataaacaagtttaccagcactgtttatctcaacaacgacactatatttaccatcaccaacaataaaaatactattaaaatactcttcatcaaataaattaatacagccataaataaaatcatgcaatgtttttttattaactaaataagcttctacaacagaaatgatttctaaatcatcatcctcatcccactcgtatggctctaataattcttcatcttctttaacccaattaacaattatatctttcatatatcctcccatataattatatgtttaacttaataaatcatgttttagtatatttttatttttaattaagttataatatttgccgaggtgaaaacatggaactaatcaaaaatattattatttatggtttacttggagcaattcaaggatttagtgaaccaattcctatttccagcagtggacacttggtcatttttaaaagtattttcaaaaaattaggcctgatcttaccccaaatgaatgatataacttttgaagttatcgttaatactggttcactatttgccatcatgtattattatcgccaagatatcaaaacattattcacagctttttttggctacattcaaaaaaaagaccaaagaaattattatataaaagattttcgttattgtattctattgatcgttgctacaattcctgctgctattggaggatatttatttaatgataaaatcgaggctgctttttctgattctaaactagtaggctgtatgttacttataaccgcaatatttttattatcgattcacaaatttggttataaaggtaaacgctcagctaaaaatataaatttatttgatgcattaagaatgggaatatttcaattatttgccttactccctggtatttcacgcagtggttcaacgctgactggcggaatgttaggcggtctatctcaaaaagcagctcgtgatttttcttttttcatgtttatgcctgtaagtataggtgcaattattctcaaatttaaagattttatcacttctagtactttacaaactttatggttaccatatttaatcgcttttataatcagtatgcttgtaacctatctttcaattcatttattatttagattattagaaaaaagaaaattaattgttttctcgcgatattgtttgatcatgggaataatcgcagtgttatttttataaaaacaaaaatgatatgtcataataacatatcattttttaattattttgttgcaataacttcgacttcgattagtgctccttttggaagtttagctacttctacagcactacgtgctggaaacggctctacaaaatatgtagcataaatatcatttacagtaacaaaatcatccatattatctaaaaatactgttgttttaacaacattagaaaaatctaatccttgactttctaataatcctttaacattttttaatgcttgatgcgcctgggcttcgattccttcaggcatagtaccagtaactggatctaatggaatttgtccagaaaagaaatataaatcaccaatattaattccctggctataaggccctatagctccaggagcttgatcagttttaactacttttttcatcttaaaatcctcctcgcttttattataacaaatttttattaatttaacagttttatttttatcatcacgataaatccttgacccctaacctaaaataggtgtaatatagagaaaattaattacgaggagtgtaactatgaaatataatttttcttcccgattcgatcacattacccctagtggaatcagagctgttttagaaaaagcggctggtccggatatgatcaatttttcacccggctttccagataacgatgcttttcccactgaagaaattaaaaggatctcggctgaagttttacaagaagaaatttatcctattttacaatacgctagaaaaccagctttacccgctttaaaagaagctcttaaaaaatttttgaatcgtcaggaatatatcgtcaaagaaaacgatgatattacagtcacttccggttctggtgaaggcttagagatggcagctaaagtatttttagatcccggtgatagtattattgttgaagaccctacttttgttggagcattaaatggctttttaagtaatgaagctaaattgatcggtgttccattacaagatgatggaatggatttaaaagcattagaaaaagctatgcaaactaaaccagcacctaagttattatatattattcctactttccaaaatcctacttgtattactacttcattaaagaaaagacaagcaatttatgatctttgtgtaaaatatggcattattattttagaagataatccatatggtactttgcgttttaaaggtgaagatattccaacttttaaagcaatcgataataaaggcattgtagtttattttgcaagtttatcaaaaatcatctctccaggtatccgtttagggagtattactgctcataaagatattattgctcatttcgatatcttaaaaggaactagcggcggtgctgcaacaaactggtcccaatatgtgatcacacgtttttttgaaactgttgatattgatcagcacctaaaacatttacaaaatgtatatggcaaaaaaagttcatttatgattgaaatgatgaaaaaaacatttcatcctgatgttaaatttactgctcctgacggggggatgtttatctggtttgaattaccggaatatgcagatgcaaaattattctttgaaaaagctttagcaatgcatattgccattgtatcgcaagatacttttgcagttgataaaaacagaaaaatgtcgggtattcgtttatcatttactagcgcttcaatgacccaaattgaaacaggtattagtaaattaggtgcattaacttatgaaatatgtgctaaatcagcttactaaaagctgattttttagtacttttcatatttttttacgtataatttaattgaggtgatatttaatgaaacaagcattagtattagctggcggtggtgcaaaaggagcctatcaagccggctgtatcaaggccctgcatgaaatgaaatatgaattcgatatcgttactggtacatctatcggcgctttaaatgccttactggtcgttcagcaagattatcaagcattatatcaattatgggataaaataaaaatcagtgatgttttaaaagatcctataaatcttgatttttcttttgaatcgatgatttcccagacaaatctaatcaaatctttctttaaatcatatcttaatgaaaaaggtgctgacatcacccctttaaaaaaattgattcattttcattataatgataaaaagttttttagcagcaaaatcgattatgggatcgtcactgtaaaatatcctagtctttctcctttagaaattacaaaacaaaaaatgaaaacaaacgaacctgtagaatttgctatcgcttctgcttcctgttttccggcttttcccgttcaccatataaaaaaacagggttacattgatgggggttactatgataatctcccaatctcattagctttaaagatgaaagctgataagattattgccattgaactctctaaagaagctaatcacgaatattatgttgatcgcccctacattacattgattcgtcctagttatgatttaggtggttttttagattttaatcgtaatcttcttgattggcgtattaaactaggctattatgatacattaaaaacatttaataagttgatggggtatcgttttaattttcatcatgctagcattgatatagagattttaaaccgtttttactggtcaatcataaattttgaagatgctattaataaaagtattattaataaatctatttttaattctaatcgtcctttgacagatttattgaaagcagatatttatcttcataagctggaacttagtgactattttattcgtggtgtggaaattgcaatggaatattatcattatcaaagtgatataatttatgattttaataatacttatttagaagtatttaacacattttctaaagactatcattatcgttaccctttattcgaaaataattttagagatttttcattaaaagatattcttacttcaataaagaaattaagtagtaaagatgctatttgtattttttatcatttattgaaaaatcatgaaaaaattgaaccaaatttgattaataatttatttttaaacgaatacttgattgccttacttttttcttgtataaaataaagatatttgttaaactcatttgggggtgattagtttgaacttaaaagtaaaaaacatgttatattgttcgatgttcgtttgtattatttcactattagcccaaattaaaatcgatctacctagtttagttccaatcacattacaaacattaggaatatatttagcgtcatgtatcttaaaacctaaattagctttttgtgtcagtcttgtatatgttttagctggagctattggtctaccagttttttctggttttggtggtggcttaagttcacttttaggtcttaccggcggttatatttttagttttccaataatggccttagtaattagcttgatcgttaataaaagatcttctaatattttaaaaataattgctatgcttattggaacaggtatttgttatttaatcggaactatctggtttatttatcttaccaagaatactctttttccatctttgatgatgtgtgtaattccatttattcctggagatatcgttaaaataattattgcgacactgttatcaaataaaatcaagttataataaaaaactagcagctgggacgactgctagttttttattatagatatcggggaaaaggatatcatatgtagtcgataattattaagagaaaggaatgaaaaactatattattatttctgactacactagtaagtatagacaataaatgtaaaaaaaattcatttaaatattattaaaaagtaacagaataatggttaattttgttataatgttttaaaggaggcaatatgaaaacaatcaaacgaatgtttatttttatcctttgcagttatttaatcattggcttgatctggattggaaaagatataactgttcattatttaaatatagatggtttaccaattcttggttatcatggagttgtagatgatgatactaaaaatacatattttagtaattatatatattatatggcaaaatcagattttgaagctcaaatggcctatttagctaaaaacaattatcataccttgactatggaagaagtagaagcttattatcatggtaattataaattaccaaaaaaagctgttgctttgacttttgatgatggcttgttgaattttaaaactgttgttaaacccattttagaaaaatataatttaaaagcaacatgttttgtaatcggctataaaactactattaaaaacaataacgatcctgccaaacatcagtatttaagaaaaagcgatttgatcaatgatgaatatgtcgaattttattctcattcctataatcttcatcataaaaataaatgcacaaaaaagatcaatactctttctttggaacaaatcgatgaagattttaatttaaataaaaatattgtcagtgacaaatactttgcttttccctatggtgcaacatgtcaaaatattatcactgttttaaaaaaacataatgttgctttagcctttggctacaatcaaaatcgtaatatgactactaatgatgaccaatatcttttaccaagatatttaatgtttagtgccatgccgatgttttatttcaaatggatcattcaataaaagctgcttaatgcagcttttaattatttataccctgatgtggtacgaatgaattatcatcaatagcctcaaaacgataaccccgtgccaaataattttcaataatagccggtaatgcctgaaccgttgttgatttagcattagtatcatgacaaagaatattaatattattagatttacttgaagtcgcattagcaatcaacttactaacagggacattattaccagaagcatccgtagaatcgccattccagtcatagtactgatatcctctatttataacttctttagataaagttgtcataattcctggtgtgtatttacgagatacagtatttgaagacccgccgggaaaacgaatgtatctaggagtaaaaccaattaaatctttgaccatatttcctacctttgtcagatcatcaaaatatcccgcaactgaagaatagactgtttgatagtcatgactataggtatgtaacccaatcgtatgacctttatcataagcttcttttattaagtaattataattttgatttgttccagtcacaaaaaatgtagcctttatattataacgatcaagtatttctaaaatcttttgtgtattagctgatggtccatcatcaaaagttaaataaacgattttttcttcactttgatttacagtaccaatttctttcttctcaatcactttaattgtccgttctatttgggtcttatttccagaacgatcagtagcgctatatgtaaccttataagttccgatcttattaagatccactttagaactatcaatatctaatttaggacttggatcacgattatcgctgacactgaccccttcttcataatcaacttttccccctttaacaactactaattcatcagtaccagtgatctccggctttgttttatcaaggactattttaactttccccttcttttcactaatattgccagcctcatcaataacttggacaacgactgttttttcaccttcatgatcaaacttataatcttttttaaatttcacttttgttttagtagcatcttcaacattttgaaccatacttttaggatcaacagtcatgccaacatcaatatctaaatcaacaacatcaaacttaggctttttagtatcaacaacttcaaccgacacagtataatctttatttttataagtatatataattgagtactcacctaacttatgataattaacttttttagtatttactttgacatccgcaatatttccatttctaacatctaaaatatttttaacagcatcaaaactatcattgatttcaattttaacattttcttctttaaaaacgattggacattttgttaaaaaataactaacaattcccactataataaaaaaaagcaataccccaataattaataattttcctctcatggaaacatttttcaatctaattcttttcatttacttcaccttctcatattgttatagtacaagattcaacaaaagtaaacaacttttatacttattaaaacaaattaagaatattattatatttcaaataaaaaagaagtaacacttaagttactccttaacaattactcttacattaataattccttttgcagattcaattcgttcaataatatcttgacgaaccatatcatttgtatcaatcaaagtatatgcatattcaccacgtgaacgattaaccatattttcaatatttaaattatgatccgcaaataatttagaaatattagccaaaatatttggcacattcttattaattatacataatctagtcttagaaacccgagcttgatttacaccaggaaaattaacagaattaataatatttccattttctaaatattcccgaatttcttcaaccgccattttagcacaattatcttcagattctggtgtactagcacctaaatgtggtaaaataataatattttcctgtccaattaattctggagctgcaaaatcactaatatatttaccaactttcccactagcaacattagctaataaatcatcattattaactaaatcaccacgagcaaagttcaagattcttacaccatctttcatttgtgcaaaagcttcttgatttaagaaacctttagtttcagcattacttggaatatgaatcgtaatataatcacattcttgataaatttcttctaaagaaacagcttgtttagcatgtttagacaacgcccaagccgcatttacaccaatatatggatcatagcctttaactttcattcctagcttgattgctgcatttgcaacattgacaccaattgctcctagcccgataactcctagtgtttttccttcaatttccggacctacaaagttgcttttacctttttcagctgtttttgcaatattttgatcatcttttaaagtatcgacccaacgaatactttcaacaattttacgtgatgataaaaataatgcacataatactaattctttaactgcattagcattagcccctggggtattaaaaacaacgattccattttcactacatttatcaatcggaatattatttaccccagccccagctctagcgattgcttttaaattttcaccaaaatcatattcgtgtaatgaagcagaacgaactaagattgcatcttcatcttttatatcttcactataattgtagctttcatcaaattcatttaatcctactgtagatattttatttaataattttatgttatacataacgtttctcctatttatttgccgcttcaaaatctttcataaaggcaattaatttttcaaccccttcaattggcatagcattatagattgatgctctaattccaccaactgaacgatgtccttttaaattagtcattcccgcttcaatgctttctttaacaaattttgcatctaaatctttattaggtgttgtaaatgtaacattcatcaaagaacgattatctttatcactatgacaaatataaaaatcactaccatcaagataatcatataatagattagcttttttgatatttctttcctgcattacttctaaaccacctaaattatcgatccattctaatactagacctaaaacataaattgcataagccggtggtgtgttatacattgaatcattttcaatcattaatttataatctaatagtactggtgttgttggtgctactttttgtaacaattcttctttaatgattgctacaccaagaccagctattcccatatttttttgtgctccggcataaatcattccatatttagatacatcaactggttttgatagaatgttagaagacatatcggcaatgataggtactccatttgtttctggaacatatttccattccgttccataaattgtattgtttgcacataaatgcacataagaagcctctggatctaattttagctcatcttgagttggaatatgtttaaaattatcaacactaccatcataagcaatattgatttcaccatactttttagcttcagctgctgcttttttactaaaagcacctgtaataatataatcagctttcccatttttcaataaatttaatggtaccatcgaaaactgttgtgtagctcccccctggataaacacgattttgtaatcatcagggatattcataacttttttcaataatccctttgttttttcaaaaatgtctaagtaggaagaggatctatgactcatctccattacactcatcccactattttcatagttcaacatttgtttagccgctttttctaaaactggcacaggcaacattgaaggacctgcagaaaaattaaatactcttttttcagtcatataaatacctttcctttcttgtaatgtatttattatattgtatacaatcttatttgtaaagccatttttacaaaattgtatacaattaacctaaaattatccaaatttaaacaatttactaaccaattattaaaaacatcactccactatatgcttcaattacaatataataactctattcaaacaaaatttaagcatcataataaacaaaaaggatgaaaactcatccttccacaatactgatccaacagtttttctcataaaacgatatcccataaccctttactttcaaatatccttcattctttatcccttcaagatatcttctatcaatgatctgctttgctgcttcttgactaacttgtactaatgaagataacttatctgcctttttacattctattactacatatggtttcaagatcgtttctggcttgattccaatatcaaaacgcccatcaccactttctcgatttgaataaacctggtatccacttaacaaccctatcataaagccatgataaaaggcttcataattatcataaaaacttactgcatgattcaatatatcatttaacagttcatttgctttatttacttcttcatttctcagtgcttctactaattcctcttttttattttgcgtatattcttcaaaataactttgaaactgattttcatatataactttaacttctttattaggtatctctaattcatactggttcaacttgatttcctgcttatcatcatatactcgatccttgatctttaaatatcctgtaaacaatagaaaactatagatattatatatatcttccatttcccgatatgtcagctctggtttgatcgtttttaaaacacttcccccctgaaccagttcttcaaattccttttttaaaacttcatttcccttttttatataattataaactatatcatttccgcttgtatttgcccaatatgaagccatcatgtcatcctgctcctggatgatttgtcttatataattaagggtactccagggattataaatatttacattaccaaataaatatccatcataccattcctttattttatcctgatattcttcaagatgataatatcttaataattcatctatctctgattgtgtaaaaccaaaatgtctacttgtcttccctttattaaaaatagaatagactgtaaaattattaagtcctgtaaaaatgctctctttagctgtctttaaacatcctgtcaatatccctttttccagtgaatcattagtttttaaaaccgaacttaacactccgcccataaaatttgtcatctcatcataatagttatgaagatatgcgctttgcaatggcacatcatattcatctatcaaaataatgaccttttgattataatgtctttttaaacatcgcgatataaataataaactatttttaatttctgtaatggtactttcaccacttctatatttctcaagcttatttttatcaacttcatccaacttatcgcttttaagcagctcatgatgctctttgataatattggaaatcagaaaagtaaattgttcgatttgttcatcaaatatcaaacctttcatatctttgaaagtcataaaaataacagggtatttattttgatatttcatgatttcttgatttttggtgatatttaaaccattaaataaataagcattatctttttcttttattgataaaaaatactgtaacatactcatatttaaagtcttaccgaatcttcttggccttgtaaacaagacaactttatcacttaatgctgattcaataaaatcactcttatcaacataataataatcatgatcaataaactctttaaaattttctgttccggtactaattgtcttcatcatatcaccctttctcatattttatcttaaatcaaacaacttcactgatccagcagtttttctcataaaacgatatcccataaccctttactttcaaatatccttcattctttatcccttcaagataccttctatcaacgatctgctttgctgcttcttgactaacttgtactaatgaagataacttatctgcctttttacattctattactacatatggtttcaagatcgtttctggcttgattccaatatcaaaacgcccatcaccactttctcgatttgaataaacctggtatccacttaacaaccctatcataaagccatgataaaaggcttcataattatcataaaaacttactgcatgattcaatatatcatttaacagttcatttgctttatttacttcttcatttctcagtgcttctactaattcctcttttttattttgcgtatattcttcaaaataactttgaaactgattttcatatataactttaacttctttattaggtatctctaattcatactggttcaacttgatttcctgcttatcatcatatactcgatccttgatctttaaatatcctgtaaacaatagaaaactatagatattatatatatcttccatttcccgatatgtcagctctggtttgatcgtttttaaaacacttcccccctgaaccagttcttcaaattccttttttaaaacttcatttcccttttttatataattataaactatatcatttccgcttgtatttgcccaatatgaagccatcatgtcatcctgctcctggatgatttgtcttatataattaagggtactccagggattataaatatttacattaccaaataaatatccatcataccattcctttattttatcctgatattcttcaagatgataatatcttaataattcatctatctctgattgtgtaaaaccaaaatgtctacttgtctttcctttattaaaaatagaatagactgtaaaattattaagtcctgtaaaaatgctctctttagctgtctttaaacatcctgtcaatatccctttttccagtgaatcattagtttttaaaaccgaacttaacactccgcccataaaatttgtcatctcatcataatagttatgaagatatgcgctttgcaatggcacatcatattcatctatcaaaataatgaccttttgatcataatgttgtttcatacatgtacaaataaacttaagagcattttgtaatttaatttcatcttctacaccctgataatattcttttaaaatttctttattaaattcactaatttggcaacttgataataactcttgattggtatcaataagatctctaattaaaatactaaatactgataattgtctattaaaagtattatttttcatatctttgaaagtcataaaaataacagggtatttattttgatatttcatgatttcttgatttttggtgatatttaagccattaaataaataagcattatctttttcttttattgataaaaaatactgtaacatactcatatttaaagtcttgccaaatcttcttggtcttgtaaacaagacaactttatcacttaatgctgattcaataaaatcactcttatcaacataacaataatcatgatcaataaactctttaaaattttctgttccggtactaattgtcttcatcatatcaccctttctcatattttctattataccattattaatttaagataagcaatgaattgatatagtgatttaacacttgaatagcgggttaaaaaaattataaatttcttattaaaatgaaaaagactttgaataaattcaaaatcttacatcattgttttttcataaatatccgcaatatttgatcccacatgttcaggatgatgagcatcactagctgttatcatcgctactccatgatccttaaaaatttttaataattcatcacttaatcccatatcacgatgattataacgataataacatccggtgttattttcagcaataacatgatgttctaccaataaatcagctaactggtgatatgttggcagtaaatcataagtaggataataattaaacattttaatagtatcaggatgtgctaattgtgtaaataaatcagatttaactaatgagaaaattaaatcatagtatcttttgtaaatatcattaacatcgtatttatcccataaaatatctttagaaaagttcatatcatataatttaccatcaatcgaatgaattgcccctactacaaaatcataatgatgcttttctaaaacacttctaatataatcttcgtgtttaggtacataacatacttctaaaccgaaagaaacttcaattggcagttccatcgctttcatttctttgattaaatcatcataatcatctaaactatctttaaatttcattgctttattttctaaccatttcttttgtaacggttcttcttttaattcagcataaataggttcaaattcaataaaacgatgtgtatgatccaaaatttggattttagttaatcctttcttttgggcagcttcaacaaactgtaacacatattccttacttaattccccatattctaaatgcatatggccatcaatcatttttattaccccctaatcttttttatttgattatatgcaaaaaaatataaatagtacagtaaaataataaaaatcttataacattaaaagagaaatatgggtataaccaaatttctcttttaatttctttattaaagaaaatcaaatactaattgatttctctttttttatttacatataagaagattgaagcaattactatacttgaaagagaataaagagtgtttacatcatcgcctgtagcaacacttgttgtatcacctgtttttacaactgatgtactttctaatccttcgattgcttttgttaaagtatctttagctttatccacctcactttgcactgcttcaggatcatttgctactgctttagctttttctagcgcttcttctactactgcccatgtctttgcactataatttactttatttagctccatcgctttagcaatcgttcctgtcaacaattctttatttgggatcaaccgcaaatctaaatatgctttcaataatccataatatgcattatctacctcatcttgtgttacatttggatcatctaatactgctttagcttttgccattggttctgctaagtttgtaacacttgcttctgtatatttactcttatctaatccttcacacctatcatacattccctgtagtaatgtcttatctgctcttaagattaagttttcaactgcatcaattaaattattgtatgcatccattacttctgtttctgtagcttcttcatttgccaatacttcttttgctgcttctaaagcttcctgtaatcctgcccacgatcctgttgtatagtcttcttcattatatccttctacttcttttattaatgcttctaactcagttttatctacctcttctactggtttgaatcttaaattcaagaatgctgttactaattcgatatatactttatctacttcgctttgactagctttttgatccgctaaaacatcctgtgctttttgtaatactggtaccatcgcattccatgattcttcaacatacttatctttatctagtcctagaatatgatttactaatccttctaataatgtcttatctgccttagctgctgtttctaagttattgattgctgtctgtaaatcagcataagctgcatctacttcttcctgcattgcattttcatcatttactaccgcattagctgcttctaaggcttctttaaatgctgtccatgaagtgactgtatagttttcttctgcataactatttgcttcattgatcaaagcttctaaagcactcttatcaccttttacaaatcccaacatctgcatcgcaactgataagcgggcaaatgaagcattgatagtttcctgactggcactatcatcagctaagattactgttgcttcttgtagtgctgctttaaattcattaacgacagctggaacgacattagctaactgttcttcagttacattatttgccatttcaacagctatcgataatgctaatttatcagtaataacctcttttttagctaaaggaatatctgttttatactcatctaaccaaacatcatttttataatctcgtggtctaatttcaactctatcttcaaaaacatttacctggtaaccaatttgagctcgtggatcaccataagattgatatttaaatgctggtacatcaactacatatccaaattctacttgatgtactttagctaaatttattccattatgaacatgtccagtaaatacgattgattgtggataatcttttagtattgctcttaatgcttcttcttgttcaccaatcaaatctaatgattcatgatctgaagttcctgtaaatgcttgatgaatttggataaaaattggtttatctatactagcatcttctttgattacttcttttaaccaatctaattgttcattagataaataagcattatcttttaaatcctgttctgtattaagtgtaataaaatgataatcattgatccaagtatcaaaatatgcctgatcttcgactccatccatataaggagtattatattttaaatatctttccataaatggtgaagtaccatatttacatgttggaatatttgcaccagcttcatttcgatcacttcctgaacacaaccagcgaacatcatgatttcctaacgaaattatgctttttgtaaagttatacttttcaatagtattatagaatgcctgatattgcccttctgatccagcatctgtaaaatcacctgggaataaaattgccgaactcgttggatctaacattgcaatgtcttctaaagcatcaactaaatttaatattgattgattatcttcttcagttccatcaatatgaacatctgataaaacctggaaactcattattggtgtttctgaagtttggaaacgatcaaaagcatttgtaagatttttgatcagctttcgcatcgtatctgcatcagcatttattttttcttcattaactgcatttaatactttttcaaattccgctattttactttcatcatagccatcttctttagcctgatttaaaacatttgtataatcttcgattttcatttgaagacggtatggtaaataatattcctcaatttctgtagtcgtaaataatcttttcattactcttacttcatcaagatatgcatcattaagtccctgagttttattaccatcagctccaatgacaaaatcaatagcatcgatactcttgccaaaagtatctttaatatctgttgtcttctctaaatttccatcaatataagcactaattacattatcacgatcaaaattaacaactatataatgccaattaccatcattagcactcaaaccatatatatcatcacgactacatccagatcctgtataattaactctaatactatcgccaaagtttccaatattcattccaacattgctgcctgtagaccagtctttattagaaataatcgccgcttcattgccaccgccatttacagttttataccagaatgaaatagcaaaatcatctgttttaaatttcaaatcatcaggctgtccaaaattcacatattgcttagctatttgcatcgtacttccgttatcgttttgaagatgtaacgcttttccgattactcctggttcataacttacatctcctacactcgtaccatgattttcacgtcctgattcatcttttacattctcgttatcaaaactcaaatataagacctgaccttcaacaacaccttcaactccatctttgactaaagccaatttaatttgaatgttacttactaaaatctcaacattactataatcatcagcttcgatagcagctttaccaatttcaatagctgtatttaaatcagttaatttatcatgatcatatttaacatttttaaccgcttcttgataaaacttatccgcatcatttacaacatattgtaaatatgttgtatcatattccgctttgatctcatctttactcattaaacgagaatatacttttaactcatcaagataagcatcatctaaaccatttttaaaatatccatctgcgccaacaacaaaattagctacatcgatcgatttaccagcatcactagaaatatctgtctttcctgctgctagattatcaacaaaagtttcaatataaccatcacgatcaaaattaataactacataatgccatattccatcaattggagcaaaattataaacatctctacgactgctgccttgggctgtaaaattcactcttaatcccgtattaaaatcaccaatattaaatccagcattacctccagaattaaaatctttattagatatcatcgcaccgccattagatacaccgttatcactttgataccagaatgataaagaaaaatcctgatcagttaacttgattttattaccaaaatcaatatattgttcagccttcgcacttgtgctgccattagaattaataatgtgaactgctttcccttttattccatcaacataacttacatttccaacaatattaccatgattaccattgccacttaaatcttcaacattatcatcaaacgatgcctttaacaatatatcaccagttggaattatatcaggttctttaaactcttcataaagtcgtgtaatttcttgatcagattttactgatttaaaaattctaagctcatctatataactatctaataaaccataacatttatttctatcagccccaataactaaatcacctaaatctaaactattatccttaaaggctgaaatatctaccgcacttgtttttattccatcagtataagtagacatcattccatcacgatcaaaagtaattacattatgatgccatgaaccatcaatagctgtgaatttaatatctttacgtgttcgattaaaagctagattagctcttatttcattagtaaaacttccaattgcgaaaccatcattagcgccactatcgtagtctttattagaaatgatcgttcctccatcttcatttccaacacttgttttataccaaaaactaattgtaaaatcttcaactcctaaagctactgcatttttcaaattaataaatgaagaaacttcagcactagaacttccattagaattaacaatatgagcagcttttcccgcaataccatcagcatatgtaatattagaagccactccatgattttcattaccactaacatcattagcattttcatcatcaaaagttaaatgaatgatttcatcatcattaagattatattctgtagctatttcagtttcattcattaaacgtgaataaacttttaattcatcaatataagcatcattcaaaccatttttaaaataaccatcagcaccaacaacaaagttagttacatcaatacttttattagcctcacttgaaatatctgtagatttaacaaactgattgtctaaataagtatcaatcgttccatcacgatcaaaattaactacaacatgatgccatactccatcaattggggcaaaattataaacatcataacgtccactattttctggggtaaaattcactcttaatccggtatcaaaatcaccaatatttaatccagcattacttccagaatcaaaatttttattagaaatcaatgctcctccagcactaactccattatcacttttataccaaaaagaaatagcaaaatctttattcgtaaatttaatattattaccaaaatcaacatattgatttgctacttcacttgtactgccattgctattaacaatatgcaatgctttacctcttactccgtcaacatattctggatttccctgaatcgtaccgttattaccattacctgatttatcctcaacattttcatcaaaatccacatatagcatttgatcattatcaaatgcatagattctaaaatttgcagaagtaaaaaataatgatagtaccaacagcatcaaacctgctttttttataaatcttttcatctcatatcctcctttatttattttccctaaaatatattttctttctttaaattatcaactcctattctatataaaaataagataacatctatccgttgctatatattaacgatatcataaaagcgcttacattattttcactttttatgaactaatttatcatttttaatatggacagttaaaatatgattttttaaaattagttgctaataaaatcttataactaatcataatttagtcataaacactataaaaccactggcttaaaccagtggtttacaatttacatcactcttgatccgatcatcaataatatatatctttattttttaattaagccagcaagtaaatctttacttggttttaatcttaaacttaagtatgctgtcgtcaattttacaaatacactgtcaatatcattttgatttgcacttacaccacttaaaacatcttgagcattttgtaaaactggtaacatgatttcccatgacgattctgtatacttactttcatctaatgtcaacatgttatttactactgtttctaaagatgcattatctacagatgtctgatactgtttaactacaaccacaaaaattttacaattgaataataattttaaaattacttacacaaattacttgacattaccaaaaatcttgcagagggattttgcactttttttgagtatatgctttattagaaaaagaaaagcatgaactcatgatatatagttcatgccattggatggcacttctgccatccattcgattaattaatcaacttagctttaatcatcaaaaccactatctggtccactgatttctccaaactctccattaattccactagttgtaataatatctttgatttcaaaacatacaatatctatttctggagttacatatgcttcctttttcaccatttctacctctctttcaattttatttatcaataattatgattttttcttaattaattccattatcaccattagctacttgctgatatgttttatcaattacaccactatatacatagtgatactgaccttttgaatcctttactacaacataacctcttgcataaacagctcgatctactgttgtaccaacatcaaaataccaaattgcacttccttctaatgatttagatgtaaatgctcttttatatactttctcttttagatcagtagtagcgccattagtattactatctgcaaatcttaatttctcatctattgaaccattacctaacacactagtactagtaccatataatactcctgcttctataactgtatattctgatggaatagagcgtgtaatttcatatgcaatcatagtacctgaagtatgaacatcagttaccgcaacctgaggtaatttttctactgtttccgcttcatctacatagaccgcataaactgacatattaccagttaacctaaatgtataattttcattactgctcaacatactaccttcaggggcattaagagcccaatgagagaattttttaccacttattgtttctgctttagctgtaactattgatccttcttcatattccattgtttgtgaagtatttaattcgttatcaatataaacatttaaagtatattttacagtttctttttcagcaccacaaaacttgcatttaccattttcataaacatgcatagatgtaattgtatcattacatgctagacaatgacgtgtatgagattcatcaccattatctgtatatgtataatcatgattgcattttctaatatttattgtagtaacttcatagttagttcctcttaattcatcaccatctaaaccagttgtaatcaagttattatcactatcataaaaagcattaccaggtgctaaagcatctttcacagtgctatcactattcactgataaaaaacaatatgttgcactaattgttgtatcactgatcataactttagcagtactagcatatgcttctattccatcaaccttcccagtaagagtacaatcattgactataaaagtcccactaccacgatgatatatagctacagcaccagcattaattgtacatctatttactgtagcagtatttaccatattatataagaataatccattacccgtagtagtatcaattacacaatcattaactgtaatttcgctactatcatatgcttgtatcccattctcaaagccactaattttactaccattaattgtaagattataagattcaccatatataccataatcatcattttcaccgacaatatcagtgttattaacaatagcattgttattagtaccaaataaaccaattgcagcgtttgctgtataccttgctttagcattcagcttgctattagtaacactaatttcattatcgctacctcttacatatatattatttggtcccgtagtattaatcgtactgctatcaatagtaatactattattattacagtcatttccatttgtatttatagcaggaaatgtactattaatcatttccagcttgttattactattacttatttggactccataggcagcagtactattattagtacaattattgattttagcaaccgtattaccttttaataatacattaccgcctggagcactgatgttattaacattagtgatactaatatttgcaccagatacatctataccataagcactagccacgatagttccgccattaattgtgatttgactttcattttctgcttttatagctgtaaatgatcgattatatgagcaattattagctaaaatattactctcgctacctgtagcatatagtcctgtcccacctaaagtgtcaattttagcatcgttgatcgtagcttcaccattagctacattcacagctatacaactatagccattaatactagaaatcgcaccaccattaatttgaacgttaccaccattagttacatatatacaattataaccatagcttgttactgtcgcatttacaagagtaagcttaccagaaacaagaattaaaccagtatcaacagaagttacacttcctgataattctcccccttcactcatacataatgtaatatcactgtcttgggttacttctaaattattagttgacgtataaccccaatctacactttgtaataaagtgactgtagctgttttaccttgggcagactcccaggctgcaaataatgcatcatcaagcgttgtatattcttcatcagaaccatagctataaacagttgttttatctccaatagtaacactagctatttccactgattctgtttcatcaggtgtttcgtcaggtgtttcatcaccgattgatggttctccagtctcattttcaactgcaaagaccattgctggtgacagggaaaacatcatacataatgaaataaatgatattaaaaatgatttttttattatttcttttttaaacatttttgtttattcctccttttcttgctattaaaattaaaactttaatttatatgatgtgattaattaatccttatatattttaataaaaattcttttttatttatataacctttgcttaaaacgcgacttttttgtttcaaatacattatttttttaatttaaatgtagtgttataattatttatcttttatttaaaatatctcaacaaaatttaacatatttatctattttttgatgcctgttaagtttaaaataaatacagcaaaacttaacataaataatatttgcttttattaaacaaattaattaaactaatattataaattagccctgaggaggtaatctatgaaaattgcaattattgatgatctagaaacagaccaaaatattttagtaaaaaaattagataattattttgctgataagaaaattgattactccatatttacatataaaaatgccgaaacattcttagaagaatttgaacctaatttttatgatattatttttatggatatttttttagataaactaaacggtatggaagctgcaaaacaaatataccaacaagataaaaaatgcaaactcatttttcttacaatatcaaatgaatttgccctcgaaagttattctgttcatgctacttattatttagttaaacctataaatgatcaatcttttttacaggcaatggaattttgtcaaatatttcctaaatacgatgtcccttttattaaagtaaaaacttctcgaattgaagtcaaaataaataccagtgatatcttatatattgatatcgccaatcgaaccacaagaattcatttaatcaacgaaactattaaagtaagcggttctttcaaagaaattaccaaaccattattaaatgattctcgctttattaattgtattagaggtattgtcgttaatatggaacacatcaatagaactgttgattcttattttgttcttaataataatgagagcattcctattagtattagaaatagaaaaagtattgaaaaaacatttcgtcactatatttttgaaggaatggtaaatagatgaaaaaaattattacgtttattatatgtataattttattaatttctaataatatggtttatgccctaaacaatgaaacagaacctgaaaatactaaaccaatcgtcaataaaatcacaagttatgacattcttactactggtattatagttgcactaaacgatcatgatgcttttaatgattttgttgaaaataaaaataaagtttatatcgctggctataatgatgatgatacagctgatgcccgtgtaataatagataatattgatattagcaatgttaatttaaacgttgctggtatatatccagtttatcttaatttaaggctggatgatgtttgtgtagatgattatatacttgacgaaggcatcaaaacagtcaccttttctgtttgtgtcagtgatccaaataactttgatatttttattatgagcgataatgcttcaaatattactttttcctggttaaaaagaaaacaaaatgaaactactgtcttttatattgaaagtgatgtaaaactaacatatcaagatctgcaaaataaatcatggcaaatattagatgacacgatcgttagcaatttttttagattaagtcaaactaagctagaattaaataaatattattatttttattttcaaaatggtcaagatgcttctgagattattcaatactataaagatcatgataaaccggtctatgaaaatattggtggtgatcgtgatgctggtgacagtaaaaacccgccgctacctgaaatagaacaacctgctccagttcctgaagaaagtgaaaataatactgcttcagtaaatgaaaatcagtccctagataataacgagtattttggaaatgataaagatatcctatcaggataccgaatctcattaatgcaggaaaatagttatcatagtcttaagttttcaaagcatggaattactatttcaattcctagttcaacgattgctgatttaaagcttcaagattctgatttagtagaaattgatattaataaagtcgatgactatagttttagctttgaaataaaaataaataatcaaaaaatagataaacttaataatatgaaagtaatgtttccttgttctttgaaagataatgttactgaaattgaaattattaataatgacagcaattataatggtacatatgattctaaattacaagtagtaacttttgaaacagattatcctggtttatatcaaataacacatttacaagagaagacaaaacctaattatttaccttatattttatttttaattgtcgtaattggttttattattataaaaagaggaattaaaaatgttaaacaaatatcttaaaatattatcaattataacagtttcttctcttttatttattgctttattttattttgataataaatacgatcaaagatctttacaagcttctaatggtttattgattctttcaaaagaagactttaaagaagatacagcttattttcttagtcgtggctggtctttctatcctgatgtactattaagtccaaaagattttcaaaatggtgatcctgatctttacatgaaagatgtaacaattggtgaaaatgctatttttgatccctatggaaaaggcacttatgttttaagaatcaaacttcctaaagaagacacttatgccctagatattccagaaatcttttctgcttatactatctatatcaatgatgaaatgatgctttcgatcggtaatcctgatcctgataattacgaggctaaaactgctaatagattgattacttttaaacaatcaggaacgatcacgatcatcatcaacgttagtaattattctcacttttatagtggaatggtatacccgccagcttttggaaatcctactagtttaaactatgtccgtggcattcatttagggataaatttaattaatataactatcatcttgattacagctgctttttcattatacttttgtattgttcgtaaacaaactaacacctttatttttttccttttatctttaacctcattaggttttatttcatatccaatcattcatacaatgtttgttacctctattttcccttggtatttttttgaagtaacatccggttatttagcgatgttattgattgttgttttacataatcgtctttgttatataaacaaaaaaactgctttgatttccatgatatcaacaggcttattttgtctactgattgccttttattgtttaaattctggaaatcttgatcttaatattattgcacttttctctgatttaatttttttatttaaaattttattagctgcttatcttttaattacaagttattatgctgttaaaaacgattatttacaagctaatctattattttacagtgaaatattttttgcctgtgcctgtatatgggatagagtctttataaactatgaacctatttatggtattcgttttattgaaggcggtattttagtagtaatatattcaattgctattttgctttggaaaaacattattaaaacctatactcttaatctagcctttattgaagaatatcgccagataactaaacaattggatatccagcaggcttataccctcaagataaaagaagtaattgatgaaaaaagacgtttgattcatgattttaaacaccatctttgcgtaatcgataacatggctaaacaaactaatcaaaaaaatataattgaatatattagtaacactaatgaattcattgacacttctaacaacttcaatattatttttactaataatgttgctgttgatgcgcttttacaatattatgcagaactttgtcaaaaacaaaatattaaattaagtcttaatttatcattacctgaagctagtccattaaatgagtatcattcttggtaatttattagaaaacagtattacagcttgtttccaacaaaaagatactcataaatttattcaaatcaatagtaaagaaactgaacatacgttttatttagtttttaagaacagttataatggtaagattagaaaaattggtagtaaatatctttcattaaaagatgatcctaagcagcatggtattggtttggaatcgataaaaagtattatttataaatatcaggggactgttgatatttatgccgataataaactatttaatgtcggtataacgattcccataagttctaaattatcaaaataaggaagaattaatttattgaaacattcaataaaactaattcttcctttttactttacttgatcctaaaaatcaaatgtatttggatcatggcttgtacgctgatttttatttaaatgatttaaaattttcatatcttcttcatcaatagaaaaagaaaaaatatctatatttgactgcattcgccctttatttttcgatttaggaatagggatgatattttgctgaacattccaccgaagaagaagcttagcaacactacagtcatatttatcagcaattttttgtaattttggatcttctagatttccacgtaataatggaccccacgccataatctgaatattattttttcgacaataatctaataattcttgattatggaggaaaggtgtgtgctcaatttgatttatcattggtggaatacgacaattcgctaaaagaaattgtaattgtgaaacttcaaaattacatactccaatacttcttacttttcctttttcatataactcttctaacgctttccatgtcgataaaatacgttctttattttgacctggccaatgaattaaaaaagcatccaaataatcagtctgtaaatcgtttaaagtttcataaaaactttttattgtttgttcataccactgatttccattatctactttactaatgagaaataattcttcacgattaatcgacactgcttgtaatgcatttccaagacttttttcatttttatacatttgtgctgtatcaaacaaacgatatccacaatctatagcattttcgatgatttctttcatcatatcttcactatcaattttaaatacccccataccaacaaggggaatgtttacaccattagataatgtaatattttccatcatatttgtcctccttatttaatatttatcatgtcattaaaaaagaagccaggggaggcttctaaatgatggatgagatttatgggagagggaatcatccatcattttgagttgtaaaacatatatgaggggattaatatattttacatattattatggttgtctttcgacactattatcctatcaccactgtatgaattaaatgtgaactaattaaaatttattctctaatccatccatgaactttacaagcattatagattccatcattgatattgctatttgtgatataatccgcctttgattttaacgcatcacaagcatttcccattgcaattttataaaaacgtttatcaaacattactaagtcattataatcatccccaaaaacaactacatcatctaaactaccacccattaaatcaatcatttcaatgattccctttttcttatcatcaggctgaaacattaagtattctttttcaaaccgtaacgatcccaaagtatcttttaaagttaattcctcttctttatcaccaggtatcgaaatatagatcttatagatattctccaacttagcataatctattttatcatcaattaaataacgtgtcggttctttacgaaacccagcctgtttaaaaaataacatatttttactaacaacatctttactatcatatggagcaactaagacaccatatcctaagctttcagcctcattaataatggctaaagctttagcatgatcaagcggggcatttctaatcaattcatgattgatcacaattccatttcccccattacaaaccatatttcttaatccagcttctttcaaaaaatcttttgctttataatatgctctacctgttgcaatagcaacaaaatgtccattttttcttaatttatctaaagcctctctagcacttggaacaattttaccagttctattatcagtaagtgttccatcaatatcaaaaaatatatattttttcattattcatcgcctgcctctctccataatccataaacagtcccaccacaaatcattcctgccaataaggcaataagaaatcttaatggatgtgctattaatggtaaaacaaaaataccaccacaaggaaccataactccacagttatacaccattgatagtccccctgtaattactgaagcaataatacatgtaactgtaactaattgcggttctttttgaataaaaggtaaaattcctttagaaacaaatgcaaaccccattaaaaaattatctcgccctagtttcttttcctgaatagaaaacttattttcaaacaaagtagttgcaaatgcaatcgctaaagccggagccatacctgctgccataattgccgccatgacatcaaaatttccttccaatatctgactaaccccaaaaatataccctattttattaacaggaccacctattgccatcattgcaccagcagccatacctaaaatcaatttaaaacctaaattcatttcaccaataaaattactgatcgtatgattaaatattcctatatagggactaattaaatatgtgatcatgccagcaaagataattgaaaatagtgggtaaataactgctgattttacttcatcaaattgtttagaaatctttttacatgatctttgtaaaaagattactgcataaccacctataaaaccagcaacgattcctcctaataaaccgggattatttacatcatttaaataaataacatttaactgtgtagcgacaccgcaactaaaccccgctgcaaaaccagcctgcttcgctatcgtttgaccaataaatccagctaaaagagcaacgatcatcccttgaatcgcattaccaaacacataactattagctatccaaacattatctactaaagaagatattccaaacaaattataggatacagctaaggttgcaatcgatatcaaagctcccgatcccactaacactggtatgatcttatcgactcccttacttaattgctgaaacatccgctttaaaattactcgattgggttttattgttttctttattttatcttgatagtgaaaaatatctatctcttcatttacagcctgatgcaacaaaatttcagctttatcactttcaacatcttttatcaagattaccggtttaccatcaaatcttgacatttctacctgtccatcacctacaataataacacattttactttttctaactcttctttaacttctaaatcatcaatttctactttaaaagaaatattcatttctttagctttactcattaaatttctcattgccctagtttcactcttacaagcatcaacaaacaaaagatcataactattttctatcttattttcaaattctttaactaaagctataaattcttcagaattttgagcactgatcaatcgttcttcaaatttacgatttcttaacatttttaataaaagtgttaaataaatattaatatcatctttaggtactgctatcaaaaaaaacaattttgctagactatctaaagaatcatctctaacgatcagaatcgataattttggttctttatctattggtacataaaaaatcatcgtttcttcacctgcttttgttgccgtttcgataatttcttgtttatcgatttcttgatcactaagctgcatcaaagcaatcaaatgatcaataacctcattattgcttattgtaccagtatataaatcaatcccttgtatatctaataaatctattatcttcattaataatcaccctcatatattaaattatcatctatattacgattcttttctagaataattttttaattacttaataaaatacacatgcattttaccgtctttagtatatactcacaactccttttcgtcaaattaagcaaataagatttaaaccctattataacaattatttgtatttaattagaaaaaaagtcagattctttaatccaacttcttctttttcaacttataaaacagcattacaaaaataattgctaaaacacctgctacgatcttacttatcatatatactaaaactccttgactatcaactacactagaaataaatcccaattgacctccaaatacatatgccccactaacactaaatgctgcatttatcatttttccctttctatccatctgactaaataaaggaatcattgcgatacttgttcctaaactcaataacaaccccataacactagtgctgtttattcctaatttttgtccaaccataaaaataactcttgaaaattttttaataataatatcacttaaaatcatcgatccacaaacaacgatacacattcttaatacaatgaccatagcttcactaatcaaaagatcattagtaaaagaaagattattaaaaaataactgtaaaattactaaagcaaacaaaatgatactaataattctaattatataaccaaataaagttagtacaaaaattgttcgatcatacgaaaaatatagtgccatgatcaagactaaacataaaagtaagattggcaaaagatttattagtaaatgagggatttgtagatataatgctacaacgatcaaaactaaaggcagacttaaaataccatataccagcccactaataaatggctgtaaatcgtctttttttaaggaagctaaaaaaatcggtaactgaaaactaattgtttgaccaagcgtagatgttaaaactactcccgaaaaaattaaaaagatttcactatttaatcctgctacaatcgaaaaaccacccatatcgggagccagaatacttccaataataatgctgggatcaaaagcagaatcagcacctattttagtaattatatcaacatttttttgaattaacgctatagcaatgcaataaaatcccgtcatgctcattgcaatacttcccattgaattgattcctttatcaaaagcttctactaaacctaagcgattatttaaaattttatctaataaacccgctaaacataaaatcaacataattaaaataaaaaaattcatccatttccctctattctatatattctaattatatttattttatcattctactaaaaaagaaaaaagagctaaacattaacaaaaataaaaaggctaacaaaataactactttaaactaattactttgttgccttttaattaaattatttcaaactttttctacctccatataaagcaattaatgctaatactactcctgcaagtgaataaataggatcgatattatcacccgtagctacacttacagttgaatcacctgaatttattacctttacatgtaatcctgccaatgcttgcgttaaagcatcttttgtaatattaacctgttcttgacttacttcaggatcatctaagacaagctgtgctttatttaatgtttcagttactatatcccatgtcttagcactatattttgtactatttaatccctttgcctgattgatcagttcttgtaatagttctttatttggtttcaatcttaactctaaatacgcttttgttagtgcttgataagctgtatctacagcctcctggctggccttttcatctgctaatactgtttgtccattttctaatactggcaacattacctgccatgatgattcgatatacttactttcatctaaactcaatactttatttaccattgcctctaaatatgtcttatctacttttttaacttcaactaaactgtcaattgcaacttgaagatcattatatacttgatctacttcttcctgcattgcattttcatcactcattactgcattggctgcttctaaggcttctttaaatgctatccatgaagtaactgtatagttttcttctgcataactatttgcttcattgatcaaagcttctaaagcactcttatcaccttttacaaattccaacatctgcatcgcaactgataagcgagcaaatgaagcattgatagtttcctgactggcactatcatcagctaagattactgttgcttcttgtagtgctgctttaaattcattaacgacagctggaacaacattagctaactgttcttcagttatgttatttgccatttcaacagctattgataatgctaatttatttactacagcaattttttcaagagcatccattgctttattaagatcaattatcattgcatctatttcttgttgatttacaccactatctaataactcaatggcttctgtaagtttcgctttaaatgcatcttttgcaggtccatcttgataatcatttaaatcaagttctttagcagtcttaattaattgttgtaattcctctttatttacaacttcttttatccgtcccataacaattaattctttaaccattacgggcgttcttttccctgaactttctaattgaacattagtaatttctaatttaatataacgagcaaaagtattttctaaattataagtatcttcaatatcatttggtaagctatccgtatctttatggcctatttcaaaccattcctcaccatcaacactgccataaacagtataatgatgccacacattgctaccaaaattaatttctacctcatcaatttgatattcttcttttaaatcaatgatcgcccatgctggagtaatcttatcttcgtatggcgcacctgtcaaactcaaacgcccagcattccaagcagttgatagattgccatcaactaaattactagaattaccacttggatcattatgcgcaatcactggtttattcaatgataaattaaatatgccacttaaatttaaatcagttatgacatcgtataaattccaatatactgtatttatttcatcaggagcagcttcattatcagctgcttttttagctgaattcaagatattattaaaatctgtaatcttactttcttcattaccacttgtatttatactttcacaaaattcaataagactttctaactgatttaaagttggtaatactctttcaccatatgctcttatttcaccaatacttaattccgcgatattatttataccgacaagcttgatataacgaacgcttccctggacagcaaattttgtttcatcacttattccttcaccaatttttaaccaatcaacactatcttcactaacccatatttcatagtcatatatatcatttacaataacattgatttcactaagttggaatattccaattaaatcaacaataacttgtggtgctttttcatcttttgctttaagagaatatgttgtcactgtgtcaccatcattaacagcacttgcatcagcttttaaatcattactatctttaacgattcctgtaagagcaagatttccaatattggcatcaacatcgccactaattgcacaattttctagtactttttctaatacttcgtaaatttcttctggcgaatccttagcatcccttgtatactcttgatcactcatattccatttccaatataaatcaaagtaaccgtttttatcaatattatttaatgatgtcccattttccatatttgcttcgactcgatttaaataatcgctccagatattagtataaagatctttaaaaattccttcgtaattacgccagccataatcttttaaactacgatgtccggctctcgatccccaagatgtaattaatgctttagcattcattgtaaatgaatccattgcaaaatcatcataattagcagcaatatcttgagccttaccaatccattcaccacctagttgttccttttgggtagcttctacttcatttaaaatttcaaaggcttttaaaaattcttctttgtattttttaaatgcttctaaatcatttgcacttttagctgctaaaacatcattgtattttaatacagcataattacttacttgttgacgcattatttcacttaaatcatataaataacattcactgtctttaaatttatcgaagtctctaataagcagtcttaaagcgctctctaattgatcagcaccataagggatattttgttccttgtaatcttgcggtgctttagatttcattccaaacaattcattagtatatcttacaccatgatcataattggcatctttcatgatctgccaggccatttgcgcattttgtgaagttccaccgtatcttctttctatatatcgatcaagccaatcatctaagtcaaaatcattatcagcccacgctaaatcaaaaatcaaatcatacattacaggattatcatattgtgcctctgagataatacctaatcctaccatgtgtgaagaagttttttgagcttccataatatcatctaccatgacctgcatctgtccatgcattgatggattaccaccaaagtttgcaagtaatccccaagcccagctagtaccattaaactctttagcatctaatttagtactaccataacttgttcgatcatattttgtccagtctgaaattggatatttaattaaatcgacgatcaatacatgatcttcgcggttatcacccattccttttaatagatcattagttggattactctgccatccctgaactacccatatagcaccttgatcataatcaagcatcgattcaagtacttcagctgcaatagtcgcatcacttaacccagcgggacggatcccaccttcatggaaaggatcgactgcataataatcactggtagctccataaacaaattcctgagcctgataaaataactgtgcatatagatcatattctttagaatctgtcgcaatcatatcaggacgactaaagccattccaattcccctgtttaattacagttacatcaggctgatattcattaaaattagttggtaccataccggcatacccttggagaatcgtttgcattcctaatgattttttccagcgttgtgaagatctagctaattctaagcgatcttttacataaccatcaggaactggtccgccaaatgtttccatattatccataaactgccatgcataataagcgggtccactcaaccagtctttagcatcatcaaaagaataaccaaaattcattaaaaatttgatccaggttgcttcttgaccagcaagatcaagcaccacattgactccatttaatgctagccaatcattctctctttgccactgttcttcaccaaagaaagcaaatgtataactcaatgtacaataattatatgcatagcgtacttgatatggcgtttcttttttgatgatttcatttactttaactagttcatcaggcatatttacctgcattgtctgttctgaaatatgcacatttaaataattcttaaaataataatttaatcccgtagtaagcgataatccttcattacctttaatatgaattttatcatcctggtcactaatttcataccagtcattttcactattatcatctacaagttcaaaactaaaccagttgcgatattcttcaccaatcgtccgatcaataataccataaacattttcaattgtctcttctttagtaattgtggctgcatactcactttcagcataagaagttacatcaagaatttcttccaaagtcccattttttaaaacaccttcatttgtttgagctgctgtaccataagctttaacttctgttaaataagctttgtcatcaccttgggtatattcaatatatactcttaaaatacgatatgacagtgctgtatcaaaaataatttcatcaccttcgtttgttgctaaagagtcaacatgtttttgatataaacggtcatatgtagaaccatcattacttccataaactgtataccagcagtttttaccttctaaagtatatatttttaatttagttaattcgtatgtatccatcaaatcaatatctacatatgatggataaaatgatcctgaccaataagtagcaagatcaccatcagttactttatcactttgggtctttgataaattacttcttgtcggtttatgataagcaatattatcaacatcctcaagatctcgcactaatactaaagcttctttagcttttaataatttttcataagaaacatgattttctaatgaagtcccttcaacatattcctgttgtacttcatttaatacttgggttaaaactgaaaaactttcttcagtataattactgctatccagctctttacattcattgatcaaagcttctaattgtcctcgataattttgataagaaccaacgatctttgcccctagtgtaccatcaccactttctttactatggaacataattgaggtatctaatttattttcggcacagacaaataccgtaatctcatttataccatttttagttaattcttttatcttactgctgatatcaatattcactgttttttgaagatctggttttgtttcatattcatcaccttgagcaattgtaaaatcacaaagcagattttcaccatcatgtttgatcgatgctggtttattattccatgtaagtgatgattcactccagttagtatcatcactataatagaaatgatatatctgcattccattattgaaccctggattcttaaacatattaaagcttaatttaaatgtatcaaaatcactttcacttatttcttctaatgtaggtaatgcaaatttcattaccccaatgatttcatttccatttggataatatttagaatttataactttataattttttcccacatattgtgctccatgcgcctgggtaatattttcatagctatatgcactagtccctttatcacttcttatataaccatcttctaagacaggatattcagctattagagcctctttagcagcaagcaatgcatcataagcattatctatttctactgttgttccattttcaagtactgctctagcattatttaaactagctgttaataaatcataacttgtctcagtataattccccttttctatcgacatacatttatcaattaactgttctagtctatttttactatagttactatttgaagcaacaagttttgctcctaaactaccatcgccactttctttactgtgaatcattaatgaagtatccgcttttgactcaccttcaacatagatagttattgctgtaatgcctttttctatcaattctttagttttttctgttatatcaattcgaattcttttttcatcatcatttttactttcatattcaaaaccttgaggaattgtaaagtcaaataaaatttcaccagttccaatacctgctggtttattattccaagtaagtgtagtttcactccaatttacatcatcagtataatagaaatgatatgtttgtcctgatttattgaaatcagggtttttaaaaatattaaactcaaagccatatgtatcaagtttgttttcattgatttcttcaatagatggcagctctaatttcattacacttatgatcttagaaccatctggataatatttggtatttattactttataattcttaccaacatactgctgcccgtgagcttgagtaatattttcataattataattattgttagcattattaccacttctaatatatgcatctgcatttacaggatatattatttcaccatcagatactgcttttgtataatttattcccgtaacaaaagtagaaattataattgctataacaagaaatccctttaatatccttctcatttttatatcctcctttgctaatatttaatttcttattatatttatattataatatatttttaagggtaaaattctacaataaatagtaaaataatacaaaaatacattaaatatatgttatatttagtaatatactttcatttaaataataaaggtaaagattattttctctaccctttaatcacaactttattctttgtgtcgccctactattacattttcattataatagtcttattaaataactctaattcatatttattagcgtaatttcttttaaaatagtttttctattctttgtgatatcaaaaaacttaataatcatagatttaatttttttaccttaatgaataaaacaacataatattcttttattttcataattttttattctaataaataattgatcatcttattttgaatatccttattaatattgtaaatagtattatcaaagtatactttttactgtttttatatctacatcattttcatagaaagccaaataaaaaagagatttttaaatctattggatatatcaatagaataaaaacctctttaaaatcttttaacgacaaataacatcaaactttgattctagtatttataagctgcttattaattatttaaaataatcagtgatactgtcttgattactaaaataattgattttcattgcatctttggctctttttaaagtagcatttgcctttaaatttgccttaatacaaccttcttctaatactttcataacatatgttatatcctgttccagctcttttcgacgctgtctaatcggattcaaattttcttctaaaacattaaacaagaatttctttatttttacgtcacctaacccaccttgacgataatgatttttcaattcatcaagattcttatattctggtaaatatttttcaaaatattcatctttacaaaaacaatctaaataagtaaatactgtatttccctcaactgttcctggatcagaaacttttaaatgatttgggtcagtatacatactcatgacttttttacgaacctcttcactagtatctgataaataaatacaattaccaattgatttagacattttagctttcccatcaattcctggtaatctttgacatacttcgttttcagctaacataatattaggttcaactaaaacatcaccataaatacgattaaaactatgaacaatttctctagtctgttcaattaatggcatttgatcttcaccaaccggtacacaagtcgcgtcaaatgctgtaatatcagctgcttgagacactggataatttaaaaaacctacaggtatacttgtttcaaaaccacgctgttttatttcctctttaatcgttggatttcgttgaagtcttgaaactgtaactaaattcatataataagcagtaaattcaaataacgctggaacttgcgattgaataaacatcgtcgcttttttaggatctaaaccaactgacatataatctaaagccacctctaaaatattacggcgtaccttttcaggatcatcagcattatctgtaagtgcttgagaatccgcaatcataatataaatttcatcaaactcacctgagttttgtaattctactcttcttctaagtgatcctacataatgtcctaaatgtaatctaccagtagggcgatcacctgttaaaataatatttttcatttctatactccttttctaaataaaaaaggcttttatcctcaaggataaaaaccattttgccaccttgtaagacaccatcatgtctgtttttcttaacgcgaaaatcacggcgccactactaccaaagggttcattttgcttctagccaggcccattcattaaccgttttatcttgattcccaccagccatcaagtctcttaaataaaacttagttaattactcttcctagttaaacgaatttattattaattaaatgataaaacggatgatgatttaagtcaatacttatctttattttatctaaaatataatcatatttttaaatcaaagaatttaaattgtaattcaacataaaaggactgcaaaaacagtcctaatcttctttaccatcccaacagtatgtacataatttacatttatccaaaccaattgctttaatcatatcatctaaacgatgatatctaagtgaagtaaatttagaacgctttctaatttcttcacacatatttttatatctctctgtatcaggatcagcatattcttgtaatacttcatcactgacattatcgccttctaatttttgaattacacgtcgcgtaattaaatctaattcagagctagaacgtgaaaaattcaagtacttacatccaaacatgattggcggacaagcaggtcgaacatgtacttccttagctccactttcatataaaaattcagttgtttcacctaactgcgttccacgtacgatcgaatcatcaattaaaagtagtttctttccttttattaattcttttaccggaatcaatttcatttttgcaatcatattacgttgttcttgacttgtcggcatgaacgaacgtggccaagttggtgtatattttataaatggtctggcataaggaattcctgaggcatttgaataaccaaccgcatgagcaattcctgaatccggtaccccagctacactatcaggttgaatatcatcacgacctgctagtaagttaccacagcgattacgcatgcattcaacatttacaccttcatatgtagatgtaggataaccatagtacacccataagaatgagcatattttcattttgtctccaggtccttgtttaacctctattttatttggtgtcatataaacaatttctccaggtcctaaatcacgatagtgatgatatcctaaattcaaaaaggcactactttcaaaggtagcacaatatcctgttgctttttcaccaataattactggtgtacgccctaacttatctctagctgcataaataccatctgctgttaagatcaagatactcatagatcctttaattacttcttgtgcatatttgattccttcgacaagactatctttacgactaatcaatgctgctactaattcagttggattaatttctcctgaactcatttccaaaaagtgagttgacccgttagcaaaacactcttctttcaattgttctaaattattaattcgccctactgtcgtaatagcaaacgaacctacatgtgacttaaccaataaaggttgtgcctcattatctgaaatacatccaatacctaaattccctttaaactcttcaatatctttttcaaacttagttctaaatggtgagttttgaatattatgaatcgctcttttaaacccattttttccatgtacagtcatcccagcacgtctagtccctaaatgagaatggtaatcaacgccaaaaaacaaatctaatacacaactctcttttgatgctacaccaaaaaatccactcattttttattcctcctaattttacattcctattgtatattatttggaataattttcctatattttattaaataatttttgtcataaaaagaatttaggcatatgatcaacactttattttaattttaaaacaataaaaatccaatcattacaacaatcaaaaaaattcaaattaattcttttatactaaaacaagtgattttttaggttgaagcacataaatcttaccaataaatcatctttatacaaatacacttttatttaaactgtcatccacataagctatcaagcatttaattatatcatttaaagcatctactttctctaataatccttgagaaatactatactctaaatactcttgttcattataatatactttcatattagctaattcttcactattatcaacattttcaatttcatcaaattctgctgcttctaaatcataataaatacgagaaaccaaattacgatcaatttcatgattagtttcctttattttatcaccgacatgctcgtattctgttctaattaaatattgctttttctctttcaataatgtaaccatgatatgatcttgatttttaattttaatcaaaaaagaaattaatttacgaccagacattcaagtcctcctttataattcaaattaaggtatctttacataacctcaaccagaccacttttacaacaatatatgtataattataactattatgaccattccccttttttttaaacgttaaatataaaatcattttttattcaaaaatctatccataatataaaagagaccatcttgacggacggtctcttttaatcacaactaataattattagttctctttctttttctttagataagcaatcatacctaatgatgccattaaacctaaaccacttatcatactgatactatctccagtatttatacttcctgtttttcctcctgaagttactacacttgtatctcctgatgctactggtcctacagaatttgctactaggttatctatgcttgcttgcaatccttctactgctgcttttactgctgcttcatcagcattttcatttgctaatactgcttttgcttcatttaatgcttctgctactacaccccaagtttttgctgtgtagtttgcagcacttaatgtttgtgctttattgatcaattcttgtaatagatccttatttggaattaatcttaaatctaagtatgctcttatcaatgcattatatgcttcgtctacttcttcttgtgttgcatctggattatctaatactgccttagcatctaccattggttctgttaagttagctacacttgcttctgtatatttagtcttatctaatccttctaccatttcatatgcttcttgtaatcttgttttatctgctcttaaaactaagtctgtcattgcatctttcaagttatttaaagcatttactacttcatcttctaatgcattttcatctgttgctacttcttttgcggcttctaatgcttctttaaatgcagcccatgaatctgtagtatatttatcttcttcatatttttctgcttcttcaatcaaagcatttaatgctgttttatcgcctttaacaaaatccaacatatgcattgcattagctaaacgatagaaagcactatcgactgtactttgttttgcactatcattagctaaaacatctgctgcttcttgtaatgccacttcaaattctgccactacagctggtacgacattgcctaaagctccttgagcttttaaagtattagccatatctactgcaattgataatgctgttttatctacaactggaacataaactggtggaattgtaatagctttatctaatcccatcacttcaacttcataaattcttgctgctgaatctccaccttgagtaggagtatcaacgatcaatttaacatagcgtgctaaacttacttggaaagtatctgtagttgatcctgccgtattccctgttactttaacaacttcagtataatttgttccatcactacttacttgaatacgataatcacgagtatttaatcctgaaccttcgccacctatttcagcatgtgaaatagtaacactgcttacagttacttcttttccaagatcaatcgttaaagtatgtggtcgattccatccagttgcacaccatttagttgatgaaataccatctatagctttacttggtgattctgaagagcctgtataacttgttgctgaagctgttttaccaactgatagatttactatttctccatccgcttcattagaaacagtaataataccttctttaactatttcatcttcacctaatttgtttttagcttttaaagaaattgtataaactccttctttagcatagcttattactggattttcttctgtactagtttcaatatttgctccttcaaaagtccattctaaatcagttgatgaaactgaactagtattagttaattgaatttcttcatttggaacaacaaatgttttagaaacatcaaatccagcaaccgcatttggattatagttgattgcatcattgacaaattgtaatgctgtcaattcagaaacttttttaccactagttaatgaagataccttagcttgtaaagtgctctttaaactatttgcctgttcatcatttccttcaccaatagcaatcaataaatctaaagcaatcttgtctgcttctcctaaacttcttaatttatttaagttagcattacaatgacttaattcttcacttgttaaagcttcttgtaatttatcagcagctaaaatcatattatcaaactctgctgttaatgcttcaacttcagcagttgtatcttctcctttagcattctttttaatgaattgattcattaattctcttacttcaggagcatctgctctacctgtagaagcccatccagcaactaatctagaagaatgattagcaaacgtatacatatatggagctaaatcaccataaagattaataatactattttcaaatgacttattataatcatacgctggtgtattccatgaataatcagccccagttaataaagtgattttagataaatcagcatgttccattggattcataactaagaaatccaattcatttgctaaccctttatctaatccatagactggtcctaatcctaatttatcagtaatataatcagttactggataattccaccagattcctacattatcaccatatatttcttttacatattgagcattattaacatcaataccttcaggcactactgcagttcctgtccataatactctaataccagaatttaatgtttcactaaaattcttagtatatgtttttaaatttgttccatcactcattgcatttgtatcatattcagttggaactgtaactaatggtttaatatcacctttagctaaaataaattcttcattaaaacggtttaagaaagcagcttgttcagtaccttgtttatttgaaatatcatcaaagaaaatagcgaaacttcttactcccatttcatacattaattcacacttagttactaaagcctgataatcagattcagcattagaaccagtaaattgaatatcatttcctggtgaaagtgagaaaacaaaatcaactttattgtttttagcagtttgaattaattcattcattttctccatttcagcatctgggtatggatctctccattttgtacgatgatatacatcatcttttggtgcataaatatatgtatttaattttgattcaccataaaatacaatttgatctaatctattttgatgagtccatggtgtaccatagaatccttcaatagaaccacgagtggtcattgcaggttcatcttcaatttttacttcttttgcttttaatgttccatcctcattaactgccaattgagttagtgtttgaactccatagaaagttccatcaccgtctttaccctcaattaatacagtaccgccattagaactatctattcccaaaacatatccttcatcacctaaagtagctgcatccactaatcctaaattatctctaatgttatccatgctatctacttcatcatcttcttcaccgataacaaaagtagtagagccttcttgataattttcatttattgtaattgaattattttctaaatattctgttaattctcttattgcatctgaatctgcaacatcttgtcctttaatatttactgtactagttattgaaagtatgttatcttgatatgttactttttttggtgctggtactaaaatcggattttcagcactcttttcattggttaatgcatttgcattagtcataggtatattagaagccagcgttgttgttaacattgctgctactaatactttttttattaatttattattcatacacattttcccttcaatattattacaaatatttgtgaaagcagagagatgagataattcatcccacctgcttatttattattatccctttaatcattttttcttttttttactatacaagcaacaattccagtaactgatgccaaacctatagttccaaatacatttattacatcaccagtttttacactcgctgtaatatctcctgcttttacagtatttacattgttatctactactggtttttcttctaatcctgtcattgcttttgttaaagctgcttttgctttatctacttctacttggcttgcttctggattatttaatactgcattggctttctctaatgctttctctactgcatcccatgtttttgcactatagcttgctttgtttaatccatttgcctgtttgattaaatcttctagtaagtctttatttggttttaatcttaagtctaagtatgctcttatcaatgcttcatatgcattatctacttcttcctgcgttgctttttcatttccaaagacttcttgtcctgcttctaataccggcatcattgcattccatgtagattcaatatattcattttcatttaatcctaagactttatttatcgttgcttccaataatgatttatcaactacttctacttcttctaaaccatctattgctgcctgtaatttatcatatgcttcatctacttcttcctgcattgcatttacattattcattactgtatttgctgtctctaatgcatccgctaatgtctgccatgattcaggtgtatagtttccttctactaattcgtttgttgaattaattaatgcttctaattcagctttatcacctttatagaactgtaacatatgcattgctgctgctaatcttgcaaatgatccatctacttctttttgtgttgccttatcattagctaagatatcttgagcttcttgtaatgctgctttaaattctgtaactactgctggtactactttatccaactgttcttcagttacattacttgccatacctacagctattgtcaatgctgttttatctgctttaacagttactgcattctctaaattattaattgcattttgtagatttgtttctactgcttctgtatcagttcttcctgctgcataggctttttgtgcttctattaaagcatctactagatttgatactgattctgttgtttttccttcaatatctgcatctttcgcttcatttattaaatctcttaatgtattgtcttcttgtggctgttcaaatgtaaaatacatttctgaaatctgataccagtttgacttatcttctgtcaataagattcgcacatatttaactggtgttttttcgaatgtaactgttgtatccagttcactgttattcatgcttcctacagttgtccagttttcctgatctctggaaatctgaatatctgcaccatcaatcacatcatttcctacatcacttggctgaactacttgtatacctgtcatatttacttcttttgggaatgtaaagacaatttctttatctactacctgattgttattaaaccagcattttgttgatgtatcattgtctaacattttatcataactgtattttgttgcaggataaactcctacagaatagtagttatcagttgcacttacacttggtacattaccatctggaagcatcagaccatctttagctgtctgaatggcatctattgcttcgttcattttttcagctgttaattcactaccgtataaaatactcttagcattggcaactgcactttgatactgactgtatccagatacatatccattgttttcaagtggataatttacttctatgtatagtggataatattttaattctactgctttatttttagcactggtcaaatcagctaatgcttcatcaactgctaattgctcactattttcatctaaatatacttctttagctgtttgatataaagaaatataatcagaaattgtttctctaatataattttcacttaataaaggattattgatctcatttgcaagttcagttttatcacaatatagttcatacacaaaagtaaatgtatttccttcttttgtatatttaccacttacaggttgattagatattaaacgataaccataaatatcatcaccactaaattcaaaatcttcaccaactgttccatatttaactacatcattctttaaaatttttccactttcgcttatatattttaaagttacttttcctaaatcttctgcaagtaaaaattctcctgaatcaggtaattgtgactgtttttcaaaaccagcaacattacctaatttttcgtaattatcttggaattgttcaaaagtagttatttgattgcttctaacattccatgatttacttgcaagcgctctcaattcatcgctaatatcatcagttataacatcttcttcaactaaatttggattatcacaccaaactccaattgcagcacctttaataaaatcagaatcatctgcaacagtattttgttggaatttacctggtgtccactcatcgaagatcttacgatcagcattcaaattatcaaaagaatgttgttctcttccatcggtaggtttagaatttcttaaaacataatagaagaaacttgcattaatattatagattgtatcatgacctttttgaataaatgtatttaacttagcaatacttgaattccatgacatttgtgaccaaaaatcaattccaatataatcatgcattttaatcatttgtggattttcataatacgaattttcaccataataaataccatcattccaaattctaggtttaaatccacgttcatatacaaattcagctaattcattaatataattagctaaaacatctttccaagttgcacttggatcaatattagccttagcataattatctaagacacttttatattgagtagtgaatggtgcacggtcaaattccatgtattcatctccaccaatatgaaaatcagtacacccttcaaaaagatccatatattcactatataaacttctaatatatgcaatcgcttctggattagtaacatctagacctgaagcaaaatgtccacctgaactatttacttgaccatattcaggatgagctttcaagatttgatcaacatgtccaggactatcaaatgatggtataacctttattccatatttctttgcttcttttaaaatttctcttacttcatctttagtaagatattgatcagaaacaattgctggatcagtttcacattcaattctaaatcctaaattttcagaaaaatgcatttgtattgcattcatttttaaatatgacatttctctaatttggcgaataaaccaatctttagaaatatattttcttgcacaatcaacatgtaaacgtctttcagcaatatatggataatctataatagttccatacaccaatccattatttgttatcattaaattttgaattgttcttaatccatataatactgcaacttctgatgcccctgttaaacgaacaccattatcatcaatttctattttataagcctcttcgctatttgattcttcagtaattgaattctctttatcaatagtaattaaaatatctccatatccagcatctttagcttgtgcatataccatagcaaatggtgaactagatacaatttctttttccataaattcactattaattaatttaacaatctctgccaacctttcattttctaaattatcttgattagctaaaattgctaaacgagtatcacttgtcattttccaaatcttatgtgattcatctgcattataatgctgtaatacaggattagttaatgctgataattgctggtcagttaaatctgaaatttcttcattatattttagtgaaacattatttgttgctttgatcaaatatgatccattagaaaatataattgataatactaatagtaaagataaaggtactttttttattctattattttttcccttcatacatatttcctttcttactacatctttaaaagtcagcttactaattattattagtaagcttgactagtaactatcaataccttatttattaactcttctcttttttgataaataagcaattgcactcaatgataccattaaacctaaagcaccaatcatacttgttgtatctccagtttttatacttcctgttctacctcctggtgtaactgtgcttgtatctccagaagctactggtgaagaagtatttactactagattatcaatacctgcttgtaatccttcaactgctgcttttactgttgcttcatcagcattttcatttcctaatactgcttttgcttcttctaatgcttcaaccatagcattccatgtttttgctgtatagttagctgcatttaatgtttgagctttattgatcaattcttgtaatagatccttatttggaatcaatcttaagtctaagtatgctcttatcaatgcttcatatgcactgtctacttcttcctgtgttgcatctgcgtttgctaatacagcttgggcatttgccattggatctgttaatccggctacacttgcttctgtgtataggctcttatctaatccatctaccatgtcatataatgactgtaatcttgttttatcagctctcaagactaagtttgccattgcatctttcaagctgttgtacgcatcttcaacatctttttctaatgcattttcatcagctgctacttcttttgctgcatctaatgcttctttaaattgtgtccatgaatcagttgtgtagttaccttcttcatatttttcagcttcttcgatcaatgcttctaatgcagtcttatcacctttgataaatcctaacatatgaatagcattagctaaacgatagaatgcactgtcaactgtggtctggtcagcataatcattaactaaaactgttttagcgttgtctaatgcactttcaaattcagctgctacagctggtacaacattatctaaagctccttgatcttttaaagtattagctgtatcaacagcgatttgtaatgctactttatttgtttctacaacttctgttctttgtcttgcaataatttcataaatagctggtgctggatttcccgcatggaaagtcaacttaacttctaagataattttatttacatcaaatgtatttgtacctttatctaaagtaccaatttcactccagctgccattaacatcttttacacttacagttgcattgcaaactgcacttggatcctgcataatcattaatgttccaacattagtaattgaagtcattgcataagttaatgtatcaccatcatttacactatctggtgcaaatgcagttgttaaatcacggtcatataagttttcaacattaccagttgtaatagttgtatcaacaatattaatactgtcgtcacctaatacatcaactgtttcattgtatggaatctcaaatacttgtacccagttatcactagattcagttgcactaaatttaatataacgagccatttgtccttgagcgttatatgctgcctcacttaccaattgtccgttaacagttttagattggtaattttcatctttgataatatcaccaatttgtatccaggttacaccatcagttgagatttctaattttgtagctgcaaatccatcaattccatatgaagtaccttttggattacctgcataatatatagctacatcatataacggaatttcttttcctaagtcagcacgaacataacttccaactgttgctccagcacttgaatagaatttcgtattaatatttccatctaaagcattagaaataacataattttgataagttcctaaatcagtttcgactgttttagtaccagtgttatatactggtgttacagcgattttatcaattgtaacatcaatactgttatcatttttatttacaactctcacatatgtagctgttgtatcaatagctgcttttaaggttccatcttcaacagtaccttgtgcacttatccagttaactccatttacagaatattgaatttctaaattgtcaagattatcagcagttactgtaacatcagctactttcattgcttttggtaaagcaagacctactgtttcattagaattcatgataccgttaactgtatttacttcataatttcctttatttacttctactgttttaccatccaatccagacatagtcccgattacagaagcttcattttcagggaaaacattttccattaaagtagatttaatttgatctactgaatcttttaaaagtggtttaatacgtttttcacaaactttaacaacattcatttttgtaccgtttgattcaaaactttctacttcataagtttcagcttcttttaatttaatttcagttgtattaatatttgataaacaagaatctacatcaccattttgggcatcaataaatgctgacatacttgcaattcctgcttctgcaactgcttcataagcatttaagtgttgttcaatttcttcatataagtttttatcttcaacatttcttaaagctgcaacatcatttttcatttttgtaaattcagcttttaatgctgttgcagcttcaacaacaccttctttattttgaagagcagttttgaaagcttcgatagtatctactaagtatcttgattcatcaaattcaaaaccatctttaatatatgaaatattatcagcaaatcgctggaatgcttcacttgcttcaggtactaattcatcaattgctctaacccagctgcttgttctttcaaaagcaccaatattccatgaataatcagcacctgagaaaatagcaactttacttgcttcagcttgtgacattggatttaagaagaatccacttaaattatcaacatcattttctagattttccaatggtgacatcattaagttaccatcacaataatcatttactggataattccaccatgcagcaagatccttatttgttacacctgtttgtgtttttggccattcataagcatcttttgtgattgctgacattgtattagcacctgtccacattactacaacatcatcatctaaattttgccagaatggtttaaaataagttgtcatacttggtccccatccattacaataacgagttccaactacaatcaatggttttacatcaccttttacttgcacaaattctcgattaactcgattaattatctcagcatgttgtgatccacttacagaaccacctaaatcgtcatatgaaataccaaattgacgaactcctaaactatataattgctcaaatttagcaattaaggaattataatcagcatctgtataataattaaatccacttcctggatgtacgctccaacagaagctcatattatcttttttaccttctgcggctaattggcgaagttcttctgccttatcttctggatataattcacgccattgatctttatgatatggatcatcttttggggcataaatataagtattcatcttaaattcgcttgattcactcattaatgataaacgatcttcaaaactccaaggatatccatagaaaccttcaacaaatcctcttaatttaacacttggataatcagaaataactgtttctgcaattttaccatcagtcttttgttttaacatttgtgataaagttacaattccgtagtacgctccatcgctatctgctccaatgatcttaatttcacctttttcattatcatcatcactagcatttaaaatatatccctgttcttcatttaaagcttggctgtttcctcccaattcttcagcacattcatcacaatgatcgctagatgaagaaactaaaatatttgctttttgcgcatctacttcatcagaaataacataattaatattattttcttgtaataatttttctaacttcggtaatgttgcttcattttgatcaccgtgaagcactacattaacctcaccttctaaattcataccttcatttgaaatatatgaaatttcttgtggcttaggatagatatctaccgttacattatcttcattttgttcagcacttatccaagttggattagcagttaccaatgaaaaagtaaatgaagcggctaatacactctttaatatttttcctgtttttttcttcacttttatttctctcctgtttttatttttggtcgatgttttgagcaattccctcctttttaacaaatttagactgcaaatttaaaagaccgcaaaaagatataccttcatcaaaaggtataaattatcacggtcttgcctaattaaagtaacaatcctattaacatctaccatctgtattaatcatatcatcttatcaaaataacatcaataaatatattttctttttttaaatattagaatctttaaaaaaacaagcaataaatattttattatcaaactcattaactctaaatagtatatctaaaattacactatttttaaaacaaatcttattataaaaatttccggacaccctaagtatccggaaatattttaattaatcaatattttgttatccattagctcttcttttcttattttcaaataaaacaatcgatgtcacaattaatcctacaaatgcatgcattaaattaattgtatctccagtttttacacttgatatcgcatctcctgaatttacttgattatttgaatttacttctaatccagctattgcttttattaaaacatctttggcattatctacttcttcttgtgttgcttctggatcttctaatactgcttgtacattgcttaatgtttcttgcaatacattccatgattcagcactgtaacttgctgaatctaacccttttactcgattgattaaattacttaataaatctttatttggttttaatcttaagttcaagaacgcttttactaattctgtaaaggcttcatctacttcaccttgcattgcattttcatctgctaatacatcatttgctttttctaatactggcaacatatcagaccatgatgattcaatgtatttactttcatctaaaccattgatttgatctacttgtttttgtaatgcactcttatcacctttgtagaattgtaacatatgcattacatttgctagtcgagcaaagacattatctacttcactttgagtggcattagtttttgcatatacttcttttgcattttctaaagcttcgttgaattcagttactacaactggtacgacattttctaaatcagctttttcagccatttcaatagcaatttgtaaagctgttttattagtttcgattacttctttagcttcataaacttctaattcataaatagaatatccatattctgtagcccgttcaataccttgaaccttaacataacgagcattaataggatcaaagtaatgttcttttaatccactttccacatcttctactaaacatacttctgtataattttgtccatctatcgaagttaaaatcttatatttgctagggcgagcattttcccaatatatttttacattatcaattaaatactcttgacctagatctacttccaaccactcgctatcattatattctgatgaccatctcgtattatcaatattaccatcaactacattttgtggatcaaattgtactagattatcttcaatactagatactgttacatttttatgatatgccaaattttgaggcgtttcatcatcaattatatttactgtcgtttttgttgtaaaacctgtaatagctccaacaactttactgattcttactttaaatgatctatttccatccatttcatcattatcaaacagcttcactgaagcaaatgcctcactctgtccatctttaaatgttacatcttcaatcattctttggaaatcttgatcctgcaaggctgttccactttcaagtgagaatgaaacagacacttcacctttagtaccgccaacacgtttaataggaatttctactcttccagcatcttcattaacgataatatcatcatcagctatttcaatcataccactttcactatctaaaacatatatagcatctaagtgtgctgcatatcctccaccatgaggattttgaccacttaatactaattctacagtatgttctccatatgttagatcttcactttcatacacaatctgttgctctaaaaagtcttctgttccataattatctacaactattgtttcttgaccatctattctcatattgaaagtaccatgatttggacatgttgcagataaaatataaaatttagatcctttaaacttaaatgttgctttagctccaatagaatttgtccagtgacttgaattattatagaatccatcttgtgttttgcgatcatcccatgtaccttcatactgaatttgatttaatccagttccaacatcttgatcatcaataacaattaatccatctggcacatttgattctaactcaattgctgaatcagctttgtatacacctacattattaataagcggtacatcttgtgaagatagaatattgattcttatttttgaagcagtcattggcgcaagacgtactaaacgtttatatccaattgtttgaccatcaaacacttctttccatgaatcagtattttcattgtatacttcaacactaaaatgttcaattctttgtcctagcggtatatactcttgaatattgattacatcaaataatgtttcagaacctaaatcaatagttaatgaacctgtaaatgttccgtcattagttgcccaataagtatcgtaattattatctgtaacattatttggattatacgtttctactcctttattttcaccacgataacttgttgctgttactttactatttatagcaagatcttcatcaaatgtatttgtaatcactctatttaattctcttaatcttgcttcatcatcttcattaatcaaaccttttttattaggtggtacatttaataataatggcgtgtttcttcctacagaattaaaataaatatctactaacttttctaaagatttagtttcttgactttcatggaagaaccaccctggtctgattgaagtattagtttctcccatgatccaatgagtcccttcaggatcaccatgatttaaataatctgtatcataatgcggcaatgttaatgtatcgcctttaatttttgaccagcaaggttccccagcataacctgcttcattcccgatccatctaacatctggtcccatgtcagagaaaatcaaagcatttggctgtaattcttttacaagtgcaaaccattgatcaaaataatatgtttgtgttacatttgatcctttagcaccatcaaaccacacttctgaaatttccccatattcagttaacaattttgtcaactgattcataaaatacacattataatcttccccacgatcatcaccataattaggtgaattttgatcccaaggtgataaataaattcctaattttaatccatatttttcacaggcaacagacaattcttttacaatatctctaccacgaatattttcattaattgcttcattagttatatcatgatctgtacctggactatcaaacaaagcaaatccatcatgatgctttgctgtaataattacctttttaaaaccagtttcacttaaaacttttgcccattgatctggatccaattctgttggattaaaaatagctggatcttcttgtccatctccccattctttatcagtaaaagtattcactccaaaatggataaatgcagatctttcatctttattgtactctaattgtcgatcagttggtactggcccataagcctttggtgctgtaacttcaccactatcttctttacctgctaattctctgatttcatcagcagttaaagctctattaaagatatttagttcatctactgatccatataaatttccagaatcttccaatcctgctttgttatttgcaccgattcgcttagctggtccattgatcactgcacttactcggtcctggtattctccatttacatataagcttgttccactaccatcgcatacaaatgttaaatgtacccattctcctattggcgcactgtaattaaatggataatcttctactccaaattctgtgattcctacttttcctgtcttattatactgctctaatttgagttctccctgatctcctgataataaggcggtgttcgttgttcctgctgggctctctcctcgatttacccacacactggcactccagtttccttctagatctttgattcctagatcgacaaaaccatttccattaaactgaagcccttttccttcgattccttctgtccagcttactccaccattaattgttccaggatataatccagtactatcactaactgttgttcctgttccttcattcatatcccagcttgtgtttactggtacatatggttctttccagatcgtttcatctttataataattgattccctggttctctaatctttcaccatgaacgatcaatctttcctgatattcatcccagctgcgatcttcttttgccgtccagccgatttctgcatatcccaagattcttggaaatgccatatattctaatgattccagacttgataatgtctctgcccataatggacattctattcctaatacctgatcttttgatccatattttgttggttcaaaactgtatgccttttgaaccgatatcattcctgcccattgtagacctagttcacagctgctgttatatttcatatctagatatgcatagtttgctggtgatacgatttgtttaaaattacctacgaatgatgaaccgtttgtttgccagtattggattacggcatcttcactttctactatatcatcataatgctgccatccgattggtgtctttccatatttttgagctatctctgttactcgattcatgaaatatgaataatcttcatctgatgttgagtatgcttcatccccacctacatgtatatattttgatggtgatatctctgatacctgtctaaatacttcatcgatgaatttatatgtattttcattatgacattccaatgatgcccatccgacatcccatccttgatatggttttgtattgtcataaccgcttgcatatggttttccatcttcggtactatttaacattggcaatgaaaccaacgctgcccatgcatgccctggcatatcaaactcaggaatgatttctacatatctttcttgtgcatattttacgatttctttgaaatcttcttgcgtatagaatcctggtctctccccattatgtgtacaagatgttgaagctcctagatctgttaagttggcatattcttcacctttgatttctaaacgccatccctggtcatcacttaaatgcatgtgtaatttgttcatcttatattgtgcgatgttatcaatatgttcttttacttcatcaacagtaaagaaatgtcttgaaacatctatcattgttccacgatattcatattccggtttatcttcgatatgtgaacctggaatattccattctacatcactaactacttctgacttttcaatatcagctgggagcatctgtcttaaagtctgcactgctctaaatacacctgctggctgattagcaacgattttaacgccactgtcaccagtatcaatagtatagccttcttcaccctgatcttcattatcggctgttgttaaaacaatgctgttatcaatagcatcactgtcatttacaactgttaatggatatccagttgatgctctaaacttcgttgcaatatattccccaattttagctaattcacttgtttcatcactagttcttccttttacattaataacagtattagtatttaagataaagttttccgaattaatttcaagactatttggtaaaggtattaatgccggttgtgcattttcaacagttgcggaaacattattaatatttaaaggtgtcactattgttgtcaatactatcgctaatactaataatagcttaaataaatttttcccttttttcataatttgtcctttccgttataaaaatataacaatctctataatagtccccttatattccccttatcttatccaaatatcatctcctttattattaaattctttttaaatttattatacattattttttaaactcttggcattaacaattcgtttcatattttacctaaaaagtaacatttgacttaaattgttaccctcaatattttttaaaaaaataaaaaccttaatactaaattagtatcaaggctgtttgaactatgccattgaagttaaatcatctctaatttcatcaaaagcaatagcaatatttaatccatggtcaccgattctttcaaaatcaatcaatgtttctgtatacaaagcactatgttcaactgtacatgttttattacgtaaacgttttaactgattgacagaaaattcatgagtcatattatcaatactatcttcaatattatcgacctttgtaatgatattatgtaactcttctcgatttaatacattcaattccgttaaaatatttttcgtcaaatcattcataatagcgatttctgctactgcctcatctgagaaaccttcattttcatcataaagtttcttagcccgattagcaatatttacagcatgatcgcctactctttccagatccccagaagtctttaagaacaaaccaatggatttcgattcttcaattggcaattcagaagaaatagcattagttgtaaattgaatgatctctttattcaaataatcgatatacttttcatctcttaataacttttcatgtttttcttcatcatatttaacgatcaattcaaaagacctttgcacattcttttgaacaacatttaacatattttgcgtctcattaaacaattgtgtattagcaatagcactcgttccaatatgataatcattagtaaaaatcgaagcatctaaatacttagtcgatagcttatcttcaagtccttctttttccggaagaaccataaaagctaatttaactagtttattaccaaacggtaataacaaaatcgttgttacaacattaaatactgtatgcacattggcaatctgagcaggaatatttgtaggtgttaacgattccatcaactgtgcaaatgggaaaagcaaactaacaataacgaaaatcaccgttccaatgatattaaaagataaatgaatgatcgttgttcttttagcatttcttcctgttccgatactagcaagtaccgctgtgatacaagttccgatattttgtccaaatagtacataaattgctgaaggtaatgtaattaccccacttttagcaagagcctgcaagatccctactgatgctgaagaactttgaataattgctgtaaaaacagcaccaactaaaattccgactaaaggattttcaaaagtactaacaatattaacaaattcaggtgaacttctaagtggtaccattgctcctgacatcatttccattcccataaataaaatacctagtcccgcaataatacttccaaaagcatctagttttttactcttaaaaaaagcaatcaatgccactccaataaatgcaattactggtgctaatgctgtaatatcaattgcaatcaattgtccggtaatcgtagtcccaatattagcacccatgattacccaaacagcattttctaatttcatcaatcccgcattaacaaaaccaaccgtcataactgtcgttgctgatgaagattgaataacagctgtaataattgctccaacaccaacgcctaaaaagcgattagtagtgagcttttctaaaatactcttcattttatttccggcagctagttctaagccattggacatcattgtcattccatataagaatagggctaatccaccgagcatggtaaacaaatctgtaagtttcatttttatccccctgttacacagtttattttatatcctaagtaaatttaacataaaatttacaatatgcaaatactattaacaaatattaacaaattcttaacttttctatctttattttggattttttatcttttattatacaattatcttgacaattaataaaaaacaattaccattattactagacagttcatttgtaccatcctgtctataaacaaaactagggctatgcttttttatattgttttgaagcaggctttttagtgagcctgcttttttatttgatggtatagaaggaggaagaatgtattatttaaaaactgaacaaagctttgatagcgctcattttttacatggctatcatggtaaatgtgccaatattcacggtcatcgctggaaaatcgttgcaactatcaaaagtaaagaactgcttaataaccagcaaaataatggcatgatcattgatttcaaagatcttaaaaatgatttaaaaaaaattatcaatgatttagaccatgctttgattattgaaaaaggcagtttatcaaaaaaactataccaggcattaaatgatgaaaattttaaaattattgatttaccatttcgaccaacggcagaaaatctcgctaaatatatttatgagctgctagccaaaagttatgatgttgattgtatcgatgtttatgaaaccccaaataactgtgccagctatcgaggaaaagatgaataattatcgtgtcgttgaaaaatttattagtattaatggcgaaggaagtagagctggtcaactagctgcttttattcgtttttataactgtaatttaaattgcagttattgtgatactaactatgctaatggtaaaaatgctaaatatgaaatcttaactgatcaagatattttagattatttaaataagaataaagttattaatgtgactttaactggtggtgaaccgttattacaaaaaaatatcgattcattaattacattattattaaaaaataattatcgtgtcgaaatagagaccaatggcagtattgatattaagccattcattacagatgatttccgaccgctttttactttggactataaaatgcctagcagtaaaatggaaaaatacatgctattggataattatcaatatctaactaaaaatgatgttgttaaatttgtaattggtgatctcgctgatttgaataaagcaaaagaaataattgaaacgtacgatcttacaaaccgtgtcaaagtttattttagccctgtctttgatatgattaaacctcgtacaattgttgattatatgattgaacatcacttaaacaatatatttatgcaattacaattacataaatatatttgggatgtgaataaacgaggtatttaaaatgatcgatactaaaaaaattgaaaaacatatttatggaattattgaagccctaggtgatgatccaaatcgtgagggtttaaaagaaacacctcaacgagtcgctaaaatgtatgcagaagtttttgctggcatgaattatacaaacaagcaaatcgctgagatgtttaacaaaacattcgatgatgacctcgattttgccaatcaagaagttattgtcgttaaagatattgatatttttagctattgtgaacatcatctagctttaatgtatgatatgaaagttactgttgcttatattcctaatgataaagtaatcggtcttagtaagattgcccgaattgccgatatggcagcccgtcgccttcagcttcaagaaagaattggaagtgacatcgttgaaatcatgaaactgataactaactctgaagatattgctgttatcattaaaggaaaacatagctgtatgtcctcacgaggaataaaaaaagtcaatagttcgacaacgacttgtactttgtcaggccgttttgaaacagatgataaattacagatatatttatattaaggagataaaaatgaaagcattagtattatttagcggtggtgtggattctactactgctctagccatagctattgataattatggtaaagataatgtcattgccttatcaattagttatggtcaaaaacatcaaaaagaaattgaagcagcaaataatattataagttattatcaagttgaacatatttatcttgatttaactaaaatctttgcttatagtgattgttctttgttacaacattccaaccgtgatattcctcatgaatcatacgctaaacaattagctaaaactgaaggaaatccggtttctacatatgttccttttagaaatggtttatttctatctactgctgctagtattgctttatctaaaaattgtagtgttatctactacggtgctcatagcgatgatgctgctggtaatgcttatcctgactgcggtgatgttttcaacaatgctatgaatcaggcaatttatgaaggaagcggtcatcaattagaaatcagagctccttttgtgaaaatgacaaaagctcaaatcgttaaaattggcctagagttaaaagttccttatgaattaacctggtcatgttatgaaggaaatgataagccttgtggaacctgcggaacttgtcgcgatcgtcaaaatgcttttttaaaaaatggaattatcgatccattattaggagaataaaataatgagtgaaaatttaactttattaggaaataaaaatactatttataaagatgattatgctccagaagtattagaaacttttgacaataaacatcctgaaaatgattattttgtgaaatttaattgtcctgaatttacaagtctttgtccgattactggacaaccagattttgctaccatttatatcagttatgtccctgatcaaaaaatggttgaaagtaagtctttaaaactgtatttatttagttttagaaatcatggtgattttcatgaagactgtataaatattattatgaaagatttgattaagttaatggaccctaaatatattgaggtgtggggaaaattcacaccccgcggagggatttctattgatccctattgtaattatggaaagcctaatactagatgggaaacaattgcttttaaccgtttagttaatcatgatctttatccagaaaaaattgataatcgttaaataaatttttaacttgatttattatttgaaactattataatatagttgaaattagtgaaacgcgttcgctaattaattagatattccataagaaaacgaaggaggttggtccttcgttttcactattttgggcgtgcttttttatagtctatttagattttaaacgatctaaataaactaagatcaataataaaagaattagatattccatgtatggtatatctttctattatcaaatgacacgtccgtggggataaacataaaaccatttatctatacctccctaaatagggacggccatccttatttattatatcatctttaatattcaaaaacgtctcaaatttatctcaaaaaaatttacatataaataacgcttttttaaatgaatcgtcctttagagaatcctaaataaattgtgctattgcttatttccctaaaattatccatagcttttttagaaaaaactctcatcataacaataacatctaaattgctgcttgataaagcatctttatcattatttgccactaatacaacattagacattgatttccaattccctgcctgttgataaaattcgcttaagtcaggtgcacaagtaaatactccaaaatcaagattatcctccatccattttgtcgctcttgcaacaattttagaactaaatccttgtctacgaaataccggcaaagttgccacgcagcttaatccgcctatttgatatgatttttcgttgataatcacttttaattgaacaactgcagcataactaacaattctattatcaaccatgatataaaagcattgctctattaaatcactatcatgttcatctgaatcacttgtagttggccaaacgacttgtaataactcattaatttgattttttatttttaatgaggcttgctgatacgaaatattttcaactttaatcatagttataataatagatcagttaatttagcgactgtatcaacaagataatcagcttgattttccatcaattcttccaaactaccataaccatataggacccccacacaaggtaaattattttcatgagccccaattatatcatgttttcgatcaccgaccataattgcatcagctgccaaaattttatttttttctaatacataattaattacttccgcttttttttcacgactattaaattcactgccaccaacaaaatcaaaatattgtgctaaatcaaaatgatcaatgatctgctttgcaaacttttcaggttttgatgttgcaaccagcaatactttaccattttcttttaaagcttttaaacaatcaactataccatcatataccttattatcaaaaattcctttagtagaaaaatactcacgatacttaattacagcctcattagccttaacctcatcaaaaccataaaaatctctaaatgaatctctaagcggtggtccaataaaaggtaatagatcatttagatcatttacttcaattccataataatttaaagcataacgcactgatttagtaattcccatcataggatcagttaatgttccatcaagatcaaacaatatatatttttgtttcataatcatcctcctatacactaacccaattctaacatcattcatcctatctattaaagttttatatcaaaaaaatagtaaaataaatcaattagattcattttactattacattattcatcataaaaaacaaactcttgatattttctaactaatatcgttaaagcaacacctagacaattcatcgaaacaattttttcactttctaacgaaaattcagtaacatcataataaagttgataagtagaacttttagttaaaaaattttttcctaattccgtaacagataaaataggaatacttttcatatttaaaccattaacagttttaacaattcctgaagtattacctgaaaaggaaataataatgacaaaatcttcacttgtaagcgagtgtgaaataacttcaaaatttgattcaccagagacaatataattagaacgtcccgctaaaaacagctcacttgaaaattgttttgcataattattttgaacaaaacccgtagcatatatgataacttgtcgagcatgatggatatcatatactaaaggaacataattgacctgagtagcgtattcaaacgttttattgatttcctttttatatgtttctactaaatctgttgggatgattgctttttttactatttctttttttaatgcatattttagttctgaataaccggtaaatcctaatttttttgctaatcttaaaactgaactttttgacgacagcaaaatttttgccaattcattgatcgtcatatttataacttctggtttatgactttttatatattgtatcatttctttttcactatcatttaaatcagcatataacaattctgcttgtgtgtcaaaatccattattattacctctctatcatataaactattgcctggtatggttctagcataattgttttatcgtcttttgtcaaaatattatcgtaatttgaaataattaattttctattttggcaattttttggtaatgtataatttactctttgtgatgaaaatgaacaaatacaaagtaatatctgatctttatattttctttcataagcaaaaatgtctgaatcgttttcatcaattaattcaaatgttccctctacaacaatgggattttcttttctaatttgaataagtttttgataataataaaataccgaatttttatctttcaactcattttctaaattaatttctttattatcaggtgaatgatcgatccatggctttccttttgaaaaaccagcatcatcctgaccattccatggaaatggtgtacgagcattatctcttgatcgtaaataagcacatttttttatatattcttcatcttcaccattttccttcatctttttgcatacaaaaattgtttctatatctttatattgctccaatgatttaaaaggaacatttttcattcctagttcttcaccttgaaaaatataaggcgttcctttcatcatatgcaaaagagttcctaacattttagccgattcctcacgatactttccatcatcaccaaatctagaaaccgcccgaggctgatcatgattattccaataaagagaattccaaccttcatctagttctttagcccataaagttaaacttttctttaaatcacttaatttaaatttgatatctgaaaacttaccatattttccataatccaaatgcatatgatcaaattgaaagaccatattcaattctttattattaggatcagtatacaactttgcctgttctaccgtagtattagccgtttcaccaactgtcattacatcataatgtgaaagtacttctctattcatttcttgtaaaaactcatgaactcttggtccatttgaagcccccttataatatgatttagaataatcatattcaccatctgcagcatctggaaaatcttgtcttttactaatcaatgaaataacatccattctaaagccatctattcctttatctaaccaaaaacgcatttcatcataaactgcttttcttacttccggattttcccaatttaaatcaggctgttctggtgcaaagcaatgtaaataatactgatttctctctggtacataactccatgctgaacccccaaacgtagcaccccaattattaggtaaactgccatcttctttagcatctttccaaatataaaagtcagcatatttattgtccttcgaaagctttgattctttaaaccattgatgctgatcacttgtatgattgacaactagatccatgattattttaatattcatttgatgagccttttctaataattcctcgaaatctgccattgttccataaataggattaatttctcgataattttcaatatcatatccattatcaaccaatggtgatttataaattggattcaaccaaacaacatcaatacctaattttgataaatatggtaatttctcaatgattcctctcaaatcaccgataccatcatcattagaatctttaaaactttgcggatatatttgataaacaacactacttttccaccaatctttactcatcttcgtcatctgcctccaaatttcttacaacatcatttacaaaaaccgtttgctgtttggcatcttcaattgcactacgaataactgtttcatcaactttatcatagctagataaagatagcacgacacttaaaacaataggtaaactcattcccgtaataatatatacattaggatgttgcaaatattttattgcttcttgattaacactgccacctaacatatcagtaaaaataatatattcatcatttttatcgattttgccaattgcattttttaattgctgctctacgggtatattatccatatacgcacaaacggcttctatatgatctaagcttgatccaatatattgaagggtatcttttaatccctcagccatcaaatgatggctcgctaaaataatttttctcatatccatatctccaactaaactgataaaattccaaaaaatgaacaaattaaagctattataatgattaagaaaataacctggattactgataattttttagaagctaataatttgtaaactaaaaatgtcaatcctactggtaataacgctggcattatttgatctaagatacctgattgaatagctagttctacatcccctgattgataaacaagtcctactgtaactttaacaactgaaggaattaaagccccgataactgttaagcccatgattgatgctgcttctgtaaaaactgataatttatcacctaatttagtaatcagctttaatccagaatcatatcctaaatgaaataatttgatcctaaaaacaaagaataccaaattcaataataaccaaataacagcacctgttggattaccttccaatcccatataagctgcaattgatcccatgatcgttggatataagacccagataagagtatcaccaattcctgctagtggtcccatcatcccagttttaaaattttgtactgtatcgattgcttttatgccatcctcttcttccatcgctacactggcccctaataaaatatttcccatccaggtcgttgtattaaaatatttataatggttatttaatgaagcgacgtactcttcatcattttgataaatttttctaagtactttctctaaaccaaatacgattgctggtccctgctgattttcataattaaatacattacatgccataaacatatagcgaatagctgctttagttaaatctttcttttctactttattactcatcccaatcatctccttcttcaaatgtaacattttcatttgttgataactttttactttcagttatgaaaaagtaatatgctagtgctaaaccaataattgaaaccccaaacattggaacatttaaatatgcggaaaagacaaatccaatcataagcattgataaatactttttagctggcataacttgtaataataatgcaatcccaacaacaggtaacatattaccagcaattgataagccatttgtaaaccattcgggtactgctgttaaaattgtattgacgatcgtatcaccaaacaatacacataacgccgttggaatacctgtagataatgcaaaaatagctggtcctatccataaaatatgattcattttcttaaatttcattgcattgcatgctctttgtgctgcatgagttacatatgtattcaataatttagcaaatacgtctaactgaattcctagcattccaactggcacccctactgccaaagctactgcctttgcttgttcaatatcatttgttgttttacaagcaacatatacgcccactaaagatgcaagtccccagttaggaactgatgaaccgccaatattggcaacacctaaattcattaattgaaatgttcccccgataaccattgctgtttgcatatcctgcataattaatcctgcaaaaaaagctaccatgattggaaaccatgtcgttataactaaaccttgttgatcaataaccatccacatcgataataggatgatcaaaataccctgtattatttccatatttcttatcctgctttcttatttaatgtatgtttctaatgtctcttcagtttcacttggcacatagtgaaatgtaaccggaatattcattgacactaatttcttaaaatcattaacctctgcttcatcaacagataccatttttttaactgtcttctttccttcaccatcaaacatgatcccaatattaactttaggaataacaaccccattttctgctaatttaactaatgttgaaggttcccgtacgatcataaagacattatgattatcatactttccagccttaaagtttttgattgcggtctctgtatcgataattgacattcctgttcctgctggtttggacattctcattgcagctttttgaatgtcatctttactcacctcatcatcaacaaccattaatcttttcgcttttgtagctcctgcccattgggtaactacgattccatgaattaatctttgatctactcttgctaatactaaactcattttttatatcctccttgtcctttgacgtaacttagtttatctatttttgtaaacactttcaatgggttgggacgtttatggaactggttctaaaaaaatgaaaatagtgtcataaatacgggaattttctcaaaaaaaataagcatataaaatatgcttaaaataaactagtctgtaatgatccagatattatttttagtggtaaaggttttacttttaataaatgtttataatcattactcttgagccagatatttttttgttgataattaaagatcaagggcattcgctgatgaattccttccatactttcattagcatctgtagtaatgatcgcaacttctttttgaccattaacaatgcgatatactcctgccatcatcattagctggccattttcattttcaaaagtaaatttatgtttgtgaatatcccactcataaaaaccattagcaggaatgatacagcggtgattgataatatcttttttaaataaagatttttcttggatcgtttcttgacgggcattgataaccagcttattatcaaatatcttgtatccccatcttgctttagatccaattaatttatcgttgttattttcaattataaaaatattattgctgggatagtaatctatcttatcttttaatgccggttcgaaaggataatcaattttatcctctagttccattaacgcttttaattctaaaaaatatctactgcacatcgcaattaacacttcctttaaaatatctatttattgtaacaaaaacaatttaattcatgatcattaacaattcccacggcctgcaaatatgagtagatcgttatcgatcctacaaaactcatacctctttttttcaaatcattagagatctcatccgataattttgatgtagttttgaaattatcgtcaatatttttgatgatttgattattactaaaaccccaaatatatttagaaaaactaccaaattcattttgaatatccataaaaattttagcatttttaattgctgcagcaatttttcttttactcctaattattttttcattatttaataacgcagttacctttatttcatcatattgggcaatcttttttacatcaaattgatcgaatgcctctttaaacgcttcacgcttttttaagatcgttatccaagataaaccagcttggaaagtctctaataaaaacatttcatataatttttcatcatcataaacaggccttccccattcatgatcatgataatctttatatatctttgatttttcatctacccaagtacatcttttaaccattttactttctccttgtttatattattcattagatatttctaatttatcatcaagtatcgtaacccaaaaagcatcactatcatcaaaatcattatttttaaatggatatgaaggaatgatcttactattcatcgaaacatatatattatgtaacacattattttcttctgatgcatcgtattcaactaaaataaaacatttcttagaattattacgtccaaaatatgtttcataaacggtaatatcttcagatttaaaaaaatctgtttctttcttttgcgatgaagtagtttgatatattttatcattttcaggatcttgatacgcgattttataactgtacatcccattaatattagctaagcctatatttaactgctggcaataaatttcatcttttaaatcatcgattactagataattataatacttattatcatctttaaataaataggcttgaacattcgctactttattacctttttcatcatatcgaacagcttcttgataatctaacgctgtatctggatcaaatcttagccactctttattagtttcataatgataataagttgtaacacttataaatgtcatgactaaacataaggctattgtaactacaaaatatcctaaacctaatttaactgaagttattctaacctcagaaacactgatattattattttcaataatcgttttcttcactttttcaaaatgatagatcatcaatataaagcagcccataattatcactactaacaaccatgatgcttttatccctagtaaataagctaaaaatgctatcaataaactaattaaataatatatcaagatcctttttatatgatgtttgtctactaaaaaatcataaaaacccctaatcataaataatattctgattataccaataaatatcaaaatatatttaagagcaaacacttgatatggcgttgcctttaaaactaaatcaagcatattaacaattataaaaaccaaagcaaaataatatgcaaatctaaacgatctattaatatctttgatcattctgatcgctaaataaaaaaacaagcctgatatcaatgatgtaatactagaaattatctcaaacttaatatcaataaacgataaaataaatccggctataacccatctaaaaatccaactaatatctttatcccttttattaactacttccataattttccctccctaacttactaactatatcttatcatttaaatatacatcgatacaacatttaaagatgcgcaaatcaaaaaatcatatttacttgaatatgatcttttttaaattatttttgtcgaacattcttctaaattaatcacttcatcaacaatcggtaaataaaactctggttcatgactaactagaataaccgcccctttaaaagctttaattgccctttgtaatgcttctttagcatcaacatctaaatgattagtcggttcatcgagcaccaaaacattagcctctcgattcatgatcttacaaagacgaactttagcattctctccaccagacaatactttcattaatgattcaatatgttccctcgttaaagcgcatttagctagcatcgatctaatttcaccattattacgatctggaaattcttcccataaataatctaatgctgtcatcgaaacgatagcctcttcctgtttaaaaaaaccaatttcaacaaaaggatctttttctactgtgccactataaggctcttgcatcccaaccaatgtttttaataatgttgtttttcctaaaccgttgacacctttaacagcaatctttttatttctttcaaaaacaagatttagtggtatagttaaaggactatcatagccaattactaaatctttacattcaaataatactttgcctggagtcctcgcttccataaatgaaaattccggttttattttttcttttggcttagaaatcaaatccattttatccaatttcttttgtcttgaactagccatatttcgagtagctactcgcgctttatttcttgcgataaaatcttcaagatcagctatttctttttgttgtttttgataacttgctgcttgttgtctcttttttagttccgcctgctctaagtaataatcataatcacccttatatcgtgtcaataccccatcttctaaatgataaataacatttatgacctggtttaaaaaactaatatcatgactaactaaaataaaagcattatcataatttcttaaaaaattaattaaccagttaacatgctgttcatctagataattagttggctcatcaagaattagaatcattggattttctaataatagttttgttagtaaaacttttgaacgctgtcctccggataaagcatcaactggtttatctaaaccaatatcatttaaacctaaaccacctgcaacctccttgatctttacatcaatggtataaaaaccaccatgatctaaaatttcctgaatctcaccaacttcttccattaatttattcatcgttatatcatcacaatctgccatctgttcatacattgccagcatttcctgctctagatcataataatatctaaaagcatcttgtaatacttgataaatcgtttgtcctggttttaaaactgtatgctggtccaaataaccagttgtaatccgtttacaccactctatctttcccgaatcgggaatgattttaccagtaataatattaagaaatgttgacttaccttcaccattagccccaactaagccaatgtgttcaccatttaacaacctaaaactggcattttctaatatcgtccgtccgccaaaatcatgactaacattttctacatttaatatgctcatttttctctcctacttacattatttaataacaatcccaattatataatacttttgaaaaatctttatctttcaaatcagcttctgtgataaaaaaattacaaatgccactatcgccccacataatttctttatctgcaacaccaatactatcaatttgcaataacaaaatatattgactataactaaccatacttcgtggatctacttgagtaaaagcagggtatccaaataatttatgcccgaatccactattttcattaaactcatcttctgacaatatttcctctggtaaatcgtaatatgattcaattaaattatttggataaaaatgattccacttattagtaaacaattgatcaaatttataatcaccttgacaaattccttctttactactaacaaaatttaatttaaaagtatcttctataggaaaataaccttctttatcaggcaaatatttttcgatgatttctgcttcgctaacacgataatcgatttctggataataaataacacgactctctttttgagaagtcatatcatcaaaatccaaaccgtatagatcattatccaaagcccaaaactgtaatattcctttatctagatcatatttattttttggtaattcctctaaatttatttgtccaatcagttttaattgctgattattatcactaactggcactaaatctttttttcctaaatatggcagtccaccaaacttactagtaaaaatactacaatcatcaatacttaaatttatcttaataacatctttaactgtttcctgatttaaactagtcattacttttaaaaccatttctttagtaattttattttttcttttaaacataaactatcacctttaaattaatcataaatcttgtcacttttaatcttaacatgaatcttgccccatatctaaatactttattatttatcaatcaatgatgcataaaaagctgtcattaagactagtgctccaccaaaaatttctttcatactaggcatttcatgtaataaaatcagtgctagaacaatactatagacactttccattcccgaaattatacttgctgtatggacttttatttttttcaaactgctaatatatatactatgagctatcgctgtacaaacaatccccaaaaaaacaagtgctaaaaaatcaactattgttaaatttatttctacaataaataaagatggtaataatacaaatgctgctacaccttgttcatataaacagatcattttaccatcataagatttagaaaaatatcgatttattaaacagagcaaagcatagctcagtgatcctatcatgccaattactattgctgatgtcatttgattttttaaactaaactcgggaatcgttattaatattcctaaaagcattacaatagcgacaataatattttttagctttaatttttctttataaaaaaagggttctaaaaaagttacaaaaagcggaaaagttgaaaaagtaattgtcccaacagccacagttgccatatcaatagcctgaagaaatgtaaaccagtgaattgccattatcacacctgctagaacaattaaataatagtcatttctattatttagtaaaatattttctctttttatcaacatgacaatcaataaaaagacggctgaaaaaaatgcccgtgcaaacgtaatgaaaattgcaggtagtcctacaaatttaccaattactccagctagaccaaataacattacagctgcatgtaatgaaaaaatttctttgtttttcattttatcactccagttattacttatgataactatttaaaatacttttgacaagaaaagatcttaataaatacttactaagatcttcaaaattatttagataacatataaaataatacataaaaaatgtaatacactacctaataaaatccataaatgccaaatactatgcatatagcgatgtttgttttgaagtccgtaaaaaactgttccaattgtatatgcaacaccacccaatactaataaccatataccattatatccgattgcttcaggtaaaagattaattttaaaaataatgcaccagcccattgctaaataacaaatcatcgaaaatttttgattactttcaatatcaatagcattcaaaacaattcctaaaactgtacaaccccaaacaattgcaaaaattatccaagcccagaattcatcgattggtctaattgaacataataatactggtgtataagttccggcaattaaaacaaaaatcgaacaatgatccataatttgaaaaacttttttgctcttagtatttggtgacaacccatgataaatgctgctcatcgtatacaaaagaatcattgaaacaccataaataattcctgatccaattccaaaaccattacctctgacagcaccaaagacaatacataatactaatactgctatcccaaacgccccaccaacgatatggctgaccatattaaatatttcttcaccacgagtataaaccggtaaaacacgatcatctaattttatccgcttcattaaatacctccactctataactatgtatatattcctattccatcataaattcatatattaataaaacaaaaatctattatatccaagaataattattactggctcattatataaaagctgatcaatattttttattcctatcaaataatattttttttatctcttttcttacttcatttaaatcctcattacataataatggtaacaattcaacaagctcttcaggtgtagaatcccaccagttcaatttttctaataattcaattaattcatcatcaaaacgtttttttataaaacgagctggattgccacctactacacaatatggcgcaacatctttagtcacgattgagtgtgctgcaataatcgcaccatttccaatcttaacacctggcataattgtactttttcttccgatccaaacatcatttccaatcactatatctcctttaaatggtaattgttttaaatgaggtggtgttttttgagcccaaattcccccaaacacattaaaaggatatgttgaaacactgctaattcgatgattagcactacccattataaattgagttccacaagcaatcgaacaaaacttaccaattatcaatttatcaccaaattccggccaattgaaaagaacattatttttttcaaaacccgttggatcaactggatcatcataatatgtataatcaccaataaaaatattgggagctgtaattacgttttttatataacatgatgtcttatattcgtttggaaaaacatcattaggattagggatattattcattcttattcactccttttcttatctcacatcctttcacctgttattaccgtagcaactgctctaattattcgaatctttttcattcacatacctccagttacatttaaatcaagattccttgacaatgatctatttcatgttgaattatttgtgccaaataatcttgaaatgtttttattttctttttaaaactctcgtcaaaataagcaatttttattttttcataccgtttagttttcttaaccccctgatgtgataaacaaccttcctcggtttcataaagtcgtcctgatgtttttaatactataggattgatcattactaaatatttaccgttatcattaacaacaatgatatttttgtttaccccaatcatattggcagccatccccacgcactcttgttcatgagcttttattgtatccaacaaatcttgaacaactggtaaatcttctggtgttgccaaaattgatttttgacttaaactaaattgatctgtaactatctctttaatcatatttcctccaatttaatctttaaaatattttatataattcaaactcttttttattttatcattttatcatcttattataaaggactggagcatttagcaccagtcctttattaaatatcattcattttaatacatgtctcgactatttcctaggaaattttcgataaactgctatccttatttttacacttctattaatctactgcctttaattcataactaaaaccatatttaagaatataatcttctagagtccaatcattatcataaatgatctttgccgcttttttacctacataacgaaaatgccacggttcattagccattcctgtaagcgatgctttgtttttaggataacgcaaaataaaaccatacttatatgcattttttacaacccatttatattcttcagtatctccaaaaactaatttttctttatcaataacactttgactagttaaatctacacctaatcctaattgatgttcacttgatcctggctttgaaactaatccagatgctgtaatagcatcatattttttaaaatattcatcatatattttagtttgactttcatatgagcgatatccactatttaaaactaagcgataatcttcagccaaagcgtcttgatacatttgttctagtgcttttgcagcatcttttcttaattttttattttctgtatcaggagcaatagaaatattaggttctactaaatcttgaggctcataatctttaggtaaaacaaatcctttttttattaaaactaaagtgttttcaggctctaatatctcatattctttagttaccttatttttagcatcaataaaaggataagtcgttgataaaactgctgaaactggttctttaccggatgttatgtattcattaatatttttaaaagacatgccttttacatccaaatatggttttatttttgcgtaagaatatttattatcaataatcattttaaaatcttctatatctgcaattttcatcagctctatcatttcttcataactatatttaagtttttttaattgttgataacaatcttgataaaaagtatcaatatatttgataatatctttttttgacaaatcttttttatagtttttataagtttgatattctaagtaatgatgatgattagaaaattcatcccattcactaatagttattaattcatcagtttctaaaatacgcttaacatcttcttcatcaagattcaaaataatactttgttcactaaaattatagccttttatcattaatataatttgatcataattaaaaattgcaatgatcgataaaataacaacgacagctaatattgcaataataacttcatacgataatctttttttctttttatgtaacatcttttttttcaaaatcctttccctcctacatacacttttggtaaacgattccctatctgacttaatatttcattacttatagtttttgctgcttgtgctaattcttcaatacgtatttcattatgaccatcattaccaacaattattactatctcattattatcaagatcatttacctcactgacgtctactaacatttgatccatacatatacgtccaatgatcggacattttattcctttaattaaaacatgtccccttgttgatatttgtcgtggtataccatccccataaccaattggaattgttgctataacactatcatattttgcttgataggttaacccataccctaaactctcacctttagaaagattatgaatcattgcaattcgagatttaatcgacaaaaccggctttaaatcaagctcttgttttaaataatcatttatacttgatttaacaccatacataaaaataccaattcggacataatcacatttaatttttgggtaattgattaatccataactactttgaatatgtattttaccaatatagtagtgatcttgttttaatctactaattaactgataaaattgatttatctgattttttgtatataatatatcagctttcttattactgtcgcttacacataagtgtgtaaaatatccttttatttttatatttttgtatttataaagtttaataattttttgataatcatcaacagcaaagcctaaacgatgcattccgctatcgatctttatatgaacatcaatagtacaattgcagcgactaagcatttttgcatgattataatctacgatactttgaatcaaatgatacttacttagctctctagctcttattggatgagtataacctaaaatcaagatctcaccatgaatccctactttacgcaattttattccttcgtctattgtcgcaactgcatatgctttaacacctaatttctgacactgcttcgctatggctactaaaccatgaccatatccatcagctttaacaaccgccattaatgatgtttctctatggagcagtgctaataatttattaagattgtaactaagagcatctaaatcaatttctacccagctgcgactagtcaatgtatctatcataagtttttccctttcataataaaatctttaattaatgaataacttttttatacatatgactgccaggtaataataatgaatccatcttgattattacctgatatctggtattttcttttattgcttaaatatagtcgtgttttgctactcaatacacaaacaaaaaagacttcaataattttatttttatattgaaaaatgtagggattataaatagaatactttttaatcttggcatggtatgtttccaaactccattgtttttgattaataagatacgctggaatagttccaacataacgaaaacatccttgtttaatatgatttgaaacattttttaaacttcgttcaataaaaccatgattgtacattttgtgctttaaatctagatatgtatttaaatcactacaaactatatcacagcataatcctgtttgatattcactaatattactagtagcctctaaacctttaattaagataattttaggatcattattaagctctttaaatattttatttatcttcgttattacccttttttctaaaacaattttttgataagaatctatttcaatacaatattcttttggtaaagggtaatcttgatttacaagaatttgtgttccttgaaagatctgctctttattcagtacaatcgtttccatctataagtcccatttcaataatcctatctatcagttcaataaaatcataacctattcctttcatcatttggggaaaacgactgtgtgtagtaaaaccgggaatagtattgacttcattaaaatagatttcattattatttgttaaaaacatatctactcgtgcaaacccttgacaacctaacgtacgataaatgagcattgctgtatcttgaatttttttagttgttagctcatcgattcttgctggcaaatgaatttttgaagttttaagtgtatacttttcatgataatcaaaaaaaccatcagccaattctatttcatctaccaaacctacttctaaaatatctttacctataatcgcacatcctacttccctccctaatattgcttcttcaataattacttcattgtcatatttaaaagcattatcaattgctggttttaaatcctgtatatccagcacttttgaaataccataagacgaacctgctttaactggttttacaaataacggaaattgcaaagtactaattgccttactataatcactagtattttttatgacaatagcatcagctacttttatcccctgatttttgactagttcatgagctctttgcttatccatacataatgctgatgatagtattccacatccaatcaccggaatattcgctaattgcatcaatccttgaactgttccatcttcaccatttttaccatgcaggataggaaaagcagcatcaagatgacaatacttaactctatttacactaatttccattactgcctgacattttggatttaggcaaatacacacactaatattattttctaaataccaagtatcatccaaaatcttatcaacagtgccttgataatgataccattttccctctttagtgataccaatcatatataattcgtatttatgataaggaaaatgttttatcactgtactagctgattgtaaagaaacttcgtactcacttgaattcccgccaaataaaactgctattgtttttttctccatattatatcctcccttcaaaagaaaaacacttttatttgatatctatatgatatctaaaataaaagtgctattttttaatatcttcatataaaaatataacaaaattcccattattttcttacttttttctgatattagaaacaattaattactatctattatttgtttaaatacttcaaaatcctcttcttcaaatatatattcatatatcaattctatttgcttttcactcaatccttctacccattcctggcagtcttgatgatactgcttttcaagcaatttaatacatgtttgtttaagcgtttcttttttccctatctcaacgccttcttcccgtccaatctcaataccctgttcaatcccttgttcgataccctgctcgatgccttttttgattccttcttcgatccttttggctgtcttttcctcgcgctccatctctaaggattcagttctaagcttcgctaacgctaactggtttgctagtgaccatatcggctcattacttctaaacttgtcatacatctttatcaccatctccactatatcttcttctctttccttcattatagcagtgtattcattttttataaacagataacataatctttctagatcatttaatcctgcgattcctttttctttgatgatcttatcgatatgtctcatcttgataaaatagcggtagttaagattttctttttccagctctccctgatcatctcgaaacgcataatctttgatcaaacgatcatcatcttcattgataaagatgatttgatataccggtcttagctgatgatatttttcaccggtatcgatctgttctactagcagtctggcaccatagaactgaaagcgggtgctttcgctattactgttgccggccatctgcatttcgatatcaataattcgacccttttcatcaacagcacagatatcaaggatgatgtttttagcgaggatagtattttgattgatttcgggatttttaacgatcatctgttgacaatcaagatgagtgacggatttaacgatgaactttctcaattttatagattctaaagtatctctggaaagcagatatttaaaaaacaggtcattactaaaacgaacattattattatcgataacagttttttcatgaatcatattttttcctcctcattatcttttacaagataattagagaaattacttctttttaattcaaaattataaattttaattaatatttatttgttgttaaagtttatatgtctttttcttataatcaatgtattcatccccaaaatgctcctgtaaagcattttcttcaatggtaattctaatttgataacagaataggcaaaatattagaactaataccgtggataatatatttcttaatgataaagccacacctattagacttattatacttcctgtatatgcgggatggcggataaatttatatattcctttcgtaattaagtgttgttgacttgatgtttgaacattcaatgtaaaagctctttttaaagtcagtactgatattaaacgaataataatacctataacaataagactaatacctatgtaagcaaaagtattaggaaatatgattttctgaattaccacaggagatttttgactgacgaaataaaagctcactataatgcaaactaaaaaattagcatataatagccatttagtacctttgtcggctttgtttactttctgattacatgatttttgataagtatagaaaaatataaatatttctgaaaccagcaacattagaattgctagattaaacatataatattgaaacaactcattaaattttgttgggtcacccatcataatcactccttgttttttttaatagttcatttatttcatcagcttgctttttagaaatataataaaaatagtaatgtattgctatcatagctatcacatatatacatgaatataaaatgatattatgtatatttatactaaaccattttccgataattgctactcctatggtcaatggatacagcaaaagtatttcaacaaaaaagtgataaatatattttttaaaatctattattgatacaaaataatcaacaagcatcgatacaacaagataaccgataacttccagaataaaaaaacaaaatccatctttagtatagccgcttaatatattacaaaccgaagcgtataatacaataaaagtaaatgccattgaaattgctggaagatatgttcttaaaaacttagtcataataactacctcttatcttattctgtaaaatagaaatatattttcttgaaacaatcaaagactctccattgctcagttcagccaataatctatgattaggataaggtttcacatatgacaatgaagatatatttagtaatacatttttgctaatccgtacaatattagtttctgctaactcgtgttcaagtgtcaaaagattttttttacactcataaatttctgttctagtatatataaatgtttttctatcaactatttcaaagtacaaaatatcatttaaaggtatttgatacatattactttggataaacccctctataacattttcctgttgtttaatataatggataatacgatttaattgtttgcttaatttagaataacgtatatcaatttccggttcagataaaccatcttttttatataactgtattttcaacaaaacacctcctgtttttccaaaatacaatatatgcttttaaataaattctcgcaataatttttgtcgcaaataccccatagttgtttataataccatcaaaaattccgtagtatataaaaatgaaaataggatacttctcgtatcctataccaattttcgattcatccatttaccacttctatatcgccaaacaaagaaaatacagcgcactacccaatcgataaacattgcaatccaaacacctaataaccctagattcatatagcgacctaaaatataactaaaacatagtctaaaaatcagcatggaagctgcagatactatcattgtaaatttagcgtcattagctgctcttaaaacattgggaaaagtaaatgataaaggccaaatagtggctccgatgattgcatgcaaaaaaatacattgatatgcaagatcagtagttttagatgaaagagaataaaaagttaaaatagtaggtgttgctataaccaaaacactaattaaaaccgccatcgaaatatatgtgattttcattaatttttttacatagtattttgcctgcttataatcatcagcaccaacacattgtcctattacagtaaccatggctaaagacattgccattcctgggatgatttgcatttgagctaaattattagaaactgcatttgctgcaatcgaataagtaccgaaggtagcgatcaaactttgcactaaaatcttaccaaattgaaacatcccattttctaaacccgaaggaattccaatttgtagaatcttttttatatacgtaaaatcaaatttccaatgcaaataatcatctatacaaatatctaaatctttatgacttaatgtttttaaaataacacagcatgccacagctcttgcaattaatgttgctaaaaccgcaccaaaaacaccccagtttaatccaaaaataaatattgcatttaaaatgatattaattacattcattactgcactattgatcattgaaatctttgaattaccaattgctctaaacaaagcagcacccgaattatataaagcaataaaaggatatgacatagctgaaaacaaaaaatagatttcagcatttttcattacttcaacttcaacattaccaaaaattaaatgtaacaaagcagcattaaaaaagattacaatagccattatcactaatgaaattatagctgtaattaaaattagctgcttagctgaatgttttgccttatctactgctccctgtccaataaattgagcagctactacagcgcccccagtccctaaagccgaaaaaatattgatcagcaaaatatttataccatcaactagtgagactgctgatacagcagcctccccaacactggccaccatcacagtatcaaaaaaaccaaccatgataattagtaactgttctacaacgagtggtccaattaatttttttaaatctttattactaaataacatatatttcaccccctatgcaaacatattatacgcttatctattttggatagtaaacaatttctatttttgaaatacaaaaattattttaataaataaaatatttgttaattaatttaaatacttttaagggtatccaataataaactggatacccttgttatttaatattcactaagtttttatacttaacactgaactttcttctttttattaatttgatatagagccatcaaagcagataacgtaccaattgaaacaataggcataattgtagtagtatcaccagtagcgacacttgctgttgaatcacctgcttttactggattactagtttcttttatttctacttgtaatcccgcaattgcttttgttaaaacatcttttatagtatctacttgatcctgtgttgcttctggatcttctaataccgcttttgcttcatttaaagcatctgcgactactgcccatgttttagcactgtaatttgcagcgtttaagttatttgccttattgatcaactcttgtaataagtctttatttggttttaatcttaagttcaagaacgcttttactaattctgtaaaggcttcatctacttcaccttgcattgcattttcatctgctaatacatcatttgctttatctaatgctggtaacatattagaccatgttgattcaatgtatttactttcatctaaatcattgatttgatctacttgtttttgtaacgcactcttatcacctttgtagaattctaacatatgcattacatttgctagtcgagcaaaagcactatctacttcactttgagtagcattagtttttgcatatacttcttttgcatttgctaaagcatcattgaattcagttactacaactggtacgacattttctaagtcggctttttctgccatttcaatggcaatttgtaatacatacttatcagcattattttttaattctagtgctataaatgcatcagttaattcattgcataactcatctaattgctcttgtgataattcacttgaatcttgaattgcattatttacattttgtcttgcttcttcaaatactagccagctagcttcatcatataattcactatttaaatcatgataactttctaataaatgttgagcttctgtaatatcagctctttttaataaattatttaatgcctcattaagcgcatttgctgcttcatcaatttgtgattgagtaatataatcggtattaaaaatttctttagcatattttaatatttctaacattgaattataagtagacaccgtataatcatctttattacgctcatttgcatcattgattactttttctaaatcatccttatctacatttattaaagtatcttcattataaaataattcgaattcaaaaattgatggtcgtgatgcacttgtaatatttaatctaatttttgaagctgtaatagtatcaaactgactgccaaattcatatccattcgttacaccagcaacagccattttttcagaattatcaacattataagtatgtccaacaacccagttttcaccattccagtactctatattataacttgtaatataattatatgttgctttatattctacgattctagtttgatttactgatacttcttcatcaaatgttaattctaaagtcgcactagtaatatcattagttgttgcccagcgtgtcgataaagaaccgtcgattgctttaattccagtaaagttttcattataaacattgcttgctaccgcatcaattgctgtagatgcaatattttctggaccagcaatttcaattttttcattagcgattttaaaattatcaagttttccaataataccattacctattttttctgttggcaatatcattgatgttgataaattcttagtaacataacttccaaattctgttctttttccagcaccaattaatttatcatttacataaagattagtaccatctttatcggcagttatcataatttttaaccatttttctgtttccacttcatagtcaaaaacatatgtatatccatctcgttcatatcctaatttacccgtatattcaccagctttatttttttgattaagactgatcttaccatcgtttccttcaaataaagtggcatcttttgatgtgttttcatcaatataaatatcaaatgatacagtagctggaaaaccgatactatcaaatggcatctgtaaataagaatcgccatctaatactaaagcatttccagatattccctttgctgtagtagaattcaatataccgttataatcatttccactaacatctactgctttattatcactaattgtctcaaaatcaatatcaactactgtctctgtcttactttgaacatatctagcaggattacttgtagcacttggtcctgtttttaataaatattcataagatgttttaaattcatcataagactgaccttccgtcttttcaccataccaagtacgctcaccaattaaagcaataccatattttaaccgatcaaaaatatcaaaatcactaacgccatctaataagaatccatcatcattccatagtaccactgatgctcctcttaattgtggatgtgaaatcggtaatactgcaccaccacttccacgagtagtagtaatatcattaacactccattcattatataatttttcaatatttaaataattattatagttgttatttccaccaggaacaatatataaccaagatccagaacaattaataattggattaccattagcaactgtttttttaacatcagcccagtacggagcccataaataatatgttacttctttattttgtggggttacatagcctttaaaaccagaacttccatcactagacgcccatgctcttgcttcataaccacgatcttgaatatactcagtataatgattaatatattgctgcattgcttctgaatatataggtgcagaattatattcatctgttccaaaatggaaaattggtgtttgaattacggcatctccaggagcgtttcctattaactcttgagttaattcatctacaaaatcaattgtaggctgatgcaaagtagcattattaacatcagttgaagaatcatctaatattttcaaatgacgaacatcatacatattatcatgcatttctggaagtagagaaaatacggcactatgagctggtgtatccaattctgtaattacgctaactccatattttgctgcttctaattgatattcaatataatcttcttttgaaatttgatatgaatgactaccaatatttttgtcattttcaattctaaatgatgataattcttttgcttgttgaatattttcttctgatcctatttctgagttagtaattttatcaccacgatcatcattaatatgcataacaatttcatttactttaaataaaggtagcatctctgtaatttctttaatataatctaatttaatttctgaacgtgcaatatctaaagcaattgatcgtacttcatattttggataatcatgtgctgtccctttaggaattgttaattcatccaaatttaaatataatgcctgtacaattgtaacaccaccataaaacacaccatttagtgtagttgaattaatagtgatataatcatcaactgtcatgatatatccttcatcaccaagaatcgctacatcatcttcatctgttaatgaaagatagatatcaccatcttcagggtcagttcctttttttacatcaatatctaatcctactaatttattcaaatatcctgataagatatttgcctgcacttctaaactttcatcattataaataatttttgaatttttagaaatagaataatttccactttcactatgccattcttgaattgaaggaattacatttggaaattcatttttaccactatcttcatatttaccaggaatatgaattttattgtcattagtacttattgcaatatcattttcatcatttttattagtaactttatacatgatatgaacatctttatcaactaaaggctgataataaattccatctaaactaatgattgattgataatctgaaccataaatctctacatcaaaattcttagtaattgcttctgaaaaaataattttttcattagaattttccggtaattcaaatccctcagattctaattttgtaagtgccatcttagcagtttcaatctctggttctaacattgcatatctatatgcttcaatttcaaatatgcttccaccatatttattattattgctaggattcgtaaacatttttgtttgattaacttttatatatcttacttcttgagaatcaaaaacaatctcacgcatattttcaacattgatcattgggttatcttttacatctaaaattgttgtataatcattaccatctttagaaatttcaacagtatactctaaaggctctctgaaaaaattaacatttacttgagataatatctctacttcttttaaatctactataatccattgatcatctgttttatcagctgaccatctagttgtttcgtcaccatctactactttttctcctacaaattgaggatatttccaactttcgccaacttttcccccttcgactcccgaatatgatacatctttggatagagctaaatttacattgtctttttgggctccatttatcttaatttcataaattgaatagccccaactagctttcactggttcattacatttgatacgtacatatcttgctgatgtatcgctaatgaaagcatccttttcaattgtttgttttcccccttttgcatcagtatttacatatagatcagtaaaattattaccatctaatgaagtttgtatttgatatgattttgcatatgcactttcccaagaaatataaactctcaataaatcatatacattttgcaaatcaacagtaatccattgttctactgttccatcttctgaaggcccctcattttcacctaaaccagtagccatcttagaactccaacgagaactttcattgtcatcaattccatcaacagccaatgcccctattaattctgaacgggcaggtcttacactcgatgtaataactggtttattcaaggcaatattttcatattcttcaacggcattgactaaaacaattttttgcgaaaaacatgataacatcattgaaaagagcaaaataattgataatcctttttttattattttttccatatacgtttccccttttaatttataaaattttacaatctataaaatttaaatatctaattttttcaccttcccttctatcatttttagaaatcattttattacaaacaaaaaagcaagactaaaatatctagtatttagtcttgcctacttaaagtaacaatctgattaatctatattcaaatattagcataaaataataatattttcaatcataaaagtaaaatttttaacctttttctgcttttttatgctttgatacaaattagttatgtctcattcattttctaagtaataaaaaccacgcctaaaagacgtggttttctctgaggctataagcctttgttacttgctcgcgtctcaaggtgctgctttcacttcgctcaagctattgcttttgactctcgctatccctcaaagggattattttcatttttttacttttttcttcttaacttcttgttttttcttttcttcctctatttccttatcctcgaatggattttggtattccttcacactcaatttgtccatcgcaatatcatgtcgttcctgttcccttatatactttgcgactgttgcatcattcaatcctactgtactcacataatatccttctgcccagaaatgtctattcccatatttatattttaaattcgcatgtctatcgaaaatcattaatgctgattttcctttcaaatatcccatgaactttgatacactttcctttggtggaatcattactaacatatgtacatgatcagacattaagtgcccttcgattatttccactcctttatatctgcatagcgtccttaaaatttcacctatatcttttcttagttgattataaatcacttttcgtctatacttgggtgtgaagacgatgtgatatttacacatccactttgtatgtgccaatgaatttgctttttgagccatacttctatcacctttcctttcatatatgatagcttgaacaactttaatatatatcggaaaggtgaatatttgtataacttttttatcgctccacccgcatagcaggtggttttttatttcgcatacttcgtatgctcaactgacttaagtctatatattcatacaagtatgaatattaaaatcaaaaagctcctatatttacttcttattttatcatttacataatttataaatttttatcattttcatattcctaatttaattataacgtaaataaaaactgtgaagttaagatcaaaaatctcttaacttacacagtctattttattactcttcactataactatttaaaacacacaactagaatcgtttaaatgttttatcttactaaactttacttactttttttactaatataactatcaacttgtttttctaatatattaaatgaagatggtccagtagatagaattacatcatgaaaatctactgatgaaaatttttcacctaattcttcttcagctttgttataaaggtcttggaataaaaagcctgataaataatattgtaaataatttgtaggtgtctcaataaacaaattatattgttcaagcattgtatcttcacttacttcaccaaaattatttttccaataatctacataatcatcataatcccagccatcataatgaatgccaatatccattaaacaaataaatacagatgttaaacgatcatttaaacttttatattctaaaagtgttttatcttctacaggagcatatttatagccattccattcaacataagtagcccatccttcactataaccattgtaatcaattaaataacggactgttggtatattttcttgttgtttaaaatacgtatgttgatacatatgtccaggatatccttcatgttcaattgtgtcaaataaagtttgtgaatattcgccattaatataaatcaactctggcgtatcaattggagcatcaattttcccttgtaaatatgcagctggagaaaagttatctttccaagcatcaggaactgtaataatctcataatttaaattatctatttctggaaaatcttgaaaaataactgtctttaaataatctaaggtttcttctacagaagtgaaatcagaataaacaagatctgaaaaacctgttacattttgtaattcaggattatcagttaataaagttctagcttccatgatcaattcaatctgcttattttgtaaatattcttttacttcatcaactgtcatatctgttccaactctaccttgaagcattgcttcataatattccttaccatcaggactaaaatataatcctttattatcttgattagttggtgtaattgtctttagctcttctcctaaacttgtatatgcattttttaaattaaccgatactaattcttgatttttttgtttagcagctgccttttcttcatcatttaaaaattctacttgatctattctttgattgattcgctcaattaaataatcatcacttccactagtatagttttggcactgttcaatcgttttttctaatatgtttttagctaatccagaattattttcttggcgtttcttttcaacttctgcatactttaaaaatgtttcttcagcagtttctaaaatatgaaaatagctgtctaaatcattttgacgttcaaatgtgaattcacttaataataatggtaattgtgcttgaaaactaataaaacttcctaaatagctattatctaaataataataatcatattgataagcacttctttgtaaagaatcaactaaaatatcataagttaatttctgactatcagacagcttatcataatcaaatgattttaattctttaagaatcttttcacattcttttttactttccttgtaatcatcctcatcactatacggtaaatttaacaatttttctttaaaaccatagttacttggattttcaaacgtgaattcaagattcatatcgtcatctgccatcaataaagttggcaatttttcgatataagcatcaaaatcttttacttttgttgttgtcttagtttcttcttgagtacatccggctacattcaagataattaacaagcctaaaacaactgatacaatctttttaaattttttcatcttatcaacattcctttatataatatatagttatattataacctaaaaccattaagcatttccactattgatatttaatttataaataacaatcttaaatcaaaatctaacattttacaaactcgaccatttctcctatgactatagctttagaatcacatccatgaccgatctcatttgtttttattatcgctaaatcatcatttacataatttttaactaattctgttattgttggaagacattccgatttttccatttccataaaagtacccaatatgattccattaattttatcgaatactcccatctgttttaattgacttaaataagttatcattttattaacattgccacttcgagcttcaagtaataatatttttttatccatatcaggccaatacatagttcccgctaatttcaatagacatctaatatttccacctacaacaattccctgcatatgatttccttgaataaattcatactcaaaagcatataaatctcttttactttgaaaaagcgtctttgaaaaattatttacttgaattacattttcctttgatactaaattccgtatctgatacaaaaccgacttattttctgtcttagcataaatagcatttataatcgtcgttaaatcactatatccccaaaataacttattactttttttaataatttcaaaatctaaataaggtagaatttcattcgcgatatctcctccagatatgtcaaaaatagctttaatttcttcatcttgataaaaatccatcaataccttggctcgatattttccataatctttaaaatctatctcgttttcatatatatattggctaaaaacgggtttcaatcccaattgaattaaaacatctcttaacaactctattttatctcgaatagtattatataaactatttgaacaacaaactattcccactttatcattaacttttatttaaatcacctcttctctataattatatcttacaattaaaattataatgttattcggtgaattattttaattaaaataacagctatttagtcaaataaaaataataaacctagaaaaatagttaaaataatttgataaaatgataggcaaattattttaactattttattattatataaaggagctgacatacaaaaaaagaaagggtcattggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcgctgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaacagtgaaaaaatagcctgttatatgaacagtattattgatggattgacgatagcaaaaggattaagtataataagcgctcatatagcacaataccaagcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacaattataattaataaacatttttatatctaataaaaaccacgcctaaaagacgtggttttctctgaggctataagcctttgttacttgctcgcgtctcaaggcgctgctttcacttcgctcaagctattgcttttgactctcgctatccctcaaagggattattttcatttttttacttttttcttcttaacttcttgttttttcttttcttcctctatttccttatcctcgaatggattttggtattccttcacactcaatttgtccatcgcaatatcatgtcgttcctgttcccttatatactttgcgactgttgcatcattcaatcctactgtactcacataatatccttctgcccagaaatgtctattcccatatttatattttaaattcgcatgtctatcgaaaatcattaatgctgattttcctttcaaatatcccatgaactttgatacactttcctttggtggaatcattactaacatatgtacatgatcagacattaagtgcccttcgattatttccactcctttatatctgcatagcgtccttaaaatttcacctatatcttttcttagttgattataaatcacttttcgtctatacttgggtgtgaagacgatgtgatatttacacatccactttgtatgtgccaatgaatttgctttttgagccatacttctatcacctttcctttcatatatgatagcttgaacaactttaatatatatcggaaaggtgaatatttgtataacttttttatcgctccacccgcatagcaggtggttttttatttcgcatacttcgtatgctcaactgacttaagtctatatattcatacaagtatgaatattaaaatcaaaaacaagacctacactgtaagtcttgttttaaattattttttatctatatcttctttttctatttccatagaacgctagagttgcaattgcaagtcctgcaagtggatataataagtttgttgtatcgcctgtatctattgcagcagttgtgtctcctgatttaactacttctaatccattgatattagccattaggttttcataggctgcatctacttctacttgcgtgttacgtattcgctaaaatttcctgtagaatctacattataacggaaaagcctatcttccaaaaatgtaatccgaccttctacagcactttcaactttagttaattgttcactaaaagtttcagaagtaaatgttggtaaaggtacccagtagcaactgtagaacctgcaacagcaatagttaacaataacgctcctgcttttttaacctttattatattacttcctttctctatttttaaaaaataaaattttactcttcttaaataaataatatacaaattacttgattcctccatcctttttactatttgtatcatttttttatttcccgtctaattaaaaaaaatataatcgcttttattataaagttttatgattttttagcgatattttacataaattatattgatagataacgaaaaaatataaatttagaacaaaaaatcctacttgtatttataaataaagtagatttatataaaagatatctctatacaacaaaagggcctaaactttaggtccctttcgttgtataaattattaatctgtcattttaacaataattatgctaactgtgcttctttagtagcgtattcttgaacaattttttgaattttttctggtgtttcttgttttagtggataccagccttttgaatacattacatcaaatacttcacgttgaatttgataaacttctttttgaatgctaataagtttatttgcaagttcttgatttgaactttcaataatgaaggtcgtatagtcacttaataatgattttaaacataataaaatatcatttattttatcataatcattaaatgaattttcattcggaaggatcggctgttttggtggattattatccattattcaaacaccccaacaattcactataatgatttttaagagtactatttaccctgcttagtgtcatcttaatatcactatcttctacactttcttcatatgaatttaactttttgcataaaacatcaatactatttaactgatcgttaaatgaaccactatctttagttgaaatcatttttggtggtttattcataaaattcctccttcataattaggttgagcaattttacttatactatgcatgtttaaaaataaaaaagaatcacaaactagaatagtttataattcttattattttattttctatgtaaagaaatatcattaacagaaattttatatttttgataattactatcaacaaaatctaccgttccatcttcattcaatttagtaaaagttactaatccataatcctgaaactgaactcttttattttttaaataagaaatatcattagcatgatctaagatttgatcataacaatcctgttgataaagattataataaattttaaaataagttaatatcgtaatcataattggtttaattaaataattttgtcccattttcattttcattgatgcatattcaccacttattgaatttacattcaaaccaattccaataactactgcatctgattcatcctgatgcaaagcttcaaccaaaattccacaaatcttcaaatcatcaacataaatatcatttggccattttatctttccttcgattccgtatctatccaataattcaactacactacaagatgctatttgtgctaatttatacaaatcttgaggatttttaaattctttgataaggatactcattaagagatcttgtcctttttggctttcccaaatatgtccatttcgtccatgtccagcagtttgatgattgcatctcactacgctaaaatcaggtaatttatcgatatttcttttaacgtattcattggttgaatcaacctcatccaactcaatataattcatactgacacctctaatctatatctattatactacagaaaaaatctttctacaattataactaccataatataatcatattttacagtataataacatcagtattttaaaaacttaaatgcttctttatccttgcaaataaaaatgcagaaataattacggccactacttcagcaattggaaaagataaccaaattagatctatatttccaaataaagataaaatataggctgttggcaataaaacaaataattgtctaattaatgatgttaataaactataggtacctttaccaactgcttgaaatacagcactgcatacaactgaatatcctgctaaaacaaaatgaagtgctattattctaagggcagttgttccaattttaatcatatctggcgaagcattaaaaaaagctaataaagtttgaggaataaattcaaaaataattacgccaataatcataattccaatggcataaactattgctaggttgatcgttttaaacatcctatctttctttctagcccctagattataagcaataattggaatcatcccattatttaaaccatagattggcatgaagacaaaactttgtaatttaaaataaaccccaaatactgctgttgcagtagttgaaaaagtaattaaaatagtgttcattccaaaggtcattatactaccaatagataacataatgattgaaggaatgcctacagaataaatttgtttaataatatgtaaattaggtttaaatcttttaaactgaaaagtaatatcatgattatatttgatattaaaaatcaatgctaacgtaaaggcaactatttgcccagtcactgtagcaagtgccgctccagcaacttccatttttggcattccaaacattccaaagataaaaatcgggtctaaaataatgttaataattgcgccaacactttgtgttagcattgtaaataaagttcttcctgtcgcctgtaataagcgttcaaacaaaaattgtccaaataaaccaaccgataatccaacaacgatcattgcatacgctgttccataatcaactatttcttgatttgatgtctgaattctaaaaaataaatttgacattaataaaccaatgatcataaaaattaaagctgtaataatatagacaaaaattgaatttgttgcggtattatttacctgatcttgatttttctctcctaagctcctagataacaacgcatttacaccaactgccgttccacttgcaaaagcaatcattaaattttgtaatggaaaagccaaagaaacagcagttaatgcattttcactaacttgggctacaaatacactatcaacaatattatacatagcctggacaagcattgaaataatcattggtaaagacattgaaattaataatttatttaccggcattacccccattttattttccgctgccattagaaattaccctctagatatatttttgcaattatctcagccactttatcaattcctaaatcactatttattgttaaatcaaagttttttaattgtccccattttttggtcgtataataattataataattacttctcgttttatcttttttaattacatattttttataatcatcatgcttttctttataactctctttaacacgacgaattcttgattctaatggtgcatgaataaaaactttcaatacattatcataatcttctaaaatataatcagcacatccgctaacaataatacaatcatcacaatctgcaagatgacgaattatttttgactgcattgtaaatacttgatcatttaacggtaatgtaaaagcacttgatgataaactatacataaatcccgatgctttttcttctgatactcttcttattacatcaacattaaatcccatttctttcgctgctaaatcaataacttcattatcataataaaccagccctaatttttcagctactttttgagcaataagccggccccctgaaccatattccctagcaatagttataactttcttacccataagtattacctcctctatattttatattctaacataatttaacttatgttactaattttctcattttataaaaagaaaagattatttaactattaaataaaaaaggatataaccgcagtatatatccttaattatcttttatcttattaatacaattttgattgatttttctttggaaatataatcctaaaataaatgctatcagctcaccaagcggaaaagcccaccagatcatcatatcagcattactaaataatgtaaagatccatgctaccggtaatgtcacgatgatcaatctgactaatgataatattaatgattttattccaaaacctaaagcttgataaattccttggaaagcgatattagcacctgcaaacaaatatcctaaaggtactatttgtaaagctaaaactgtcatttttgttgaatcctgatttaaagagaaaactttagctagaggctcagcgaatatttctaaaaataacaatcctatcgccattaaaacaagagtataaataatcccatatttgattccatctttaacccgttttttatcttgttttccatagttaaatgcaattattggaatcattgcattatttattccaaaagcggcaaagaaaacaaattgttgaatcttgtagtaaataccaaatgcagtaaccgctgtttcgctaactaaaccataaattatatttattccatatgacataacagacattaatgattgcatgataattgctggaattccaactctgtatatcccaataatagtctttttattaggttttaaataaactaatttaccatcaatttctctattaaaataataatggaagatcatatctaaaactagtgttaaaatttgtccaataactgttgctaaagccgctcctacaatatccattttaggtaaaccaaataacccaaagattaaaattggatctaaaataatatttgttactgctcctgctaattgagcaatagttgataaatgtgtttttcctgtactttgtaatagtttttcatagatcattgaaccaattgatccaaaagataaaatacagcaaagttttaaatatgatgaacctaaagataacactaactcattagatgtttgactctttaaaaatatatcaactccaaagaaaccaaaaactaaaaacaaaatatacatacaaatagcagtaaaaattgcatttccggctactaaactagctttttcatagttcttttcacctaaatattttgataataatgaattaactcccactccagtacctacaccaatagcaaccatcaacatttgaatcgggaatgctaatgttaaagcattaattgcataatcagctaaatcagcaattgatgacgaagtaatatttgagataaaaaaagtatcaacaatgttatagaacgcctggacaaccattgataaaatcattggcactcccattgtaaacattaacttattaattggaacatagcccatcttatttttcatttccatataatcactccttaaaataaaaacgtaaatctcaattggatttacgccttagctactcattgaatcactatttagttttcataaccatatcataaataatatcagcacaatcatctaatgatagattactgctatcaatacataaatgataattagacaaatcatttaatttaccattagtataataacgataatatgtctttctctttttatcacgtttatccaattccttgattggattttttaaatcctcatgatattcatccgttactcttttagctctaacttcaatatcactatgaataaaaacattaagacaatcatttctttttcttaaaatataatcactacagtgtccaacgattacacaaggctcttgatcagccaatttaattattaaattgcgctgtaatacatataattgatcaattggcgtaatccccccgctagaccaattattaaatccaaataaaatagtatttgtatcgccatactcactattttcttttacaaattctgaagcataaccactttctttagctagctgtgctgtgattttactatcataatacttatagcctaatttttttgctaataattttccaatcttacggccaccactaccatattcatggccaattgtaattacttgatatttcattttaacctcctcaaaatacaaaaaagtattcctttacaatcggaattacatccataaaagaatactcattgcctaaataatataacacatttaaaaagattttgtaagtttttatttttagatatttcaattttggttataattctatcgattacaatatttgaaccctaaaaatcatagtgttataatactggcagataggagatgaaacaaatgacaaaagtagatattatatctggttttctaggagctggtaaaacaactcttataaagaaattagttaatgaagtatatcaaggagaaaaaatagttttaattgaaaatgaatttggagaaataggtattgatggaacattcatgaataatgccggagttgaagtcactgaaattaattctggctgtatttgctgcagtcttgtaggtgattttgaagcttcattaaaagaagtcttagaaacttatgagcctgatcgaatcatcattgaaccttctggtgtaggtaagttatctgatgtaattaaagcagttaatgacgttcatagcgataaacttgttctagataattatcttgctgttattgatgctaaaaaatgtcgtttatatactaaaaattttggtgagtttttcaataatcaaattcagtatgcttcattgattatcttgagcagaactcaagatattactgaatttcagcttgatgaatgtttaaaaattattagaaactttaatcctaaagtcaatatcgttaccacaccatgggatcaattaactaaggaaaatataattaacgcgtttagtaatagtgatgatcttcaaaatgaactattagagcaattagatatttgtcctgaatgtggtcatcaccatgatcatgaccacgaacatcatcatgaacacaaacaccatcaccacgatcacgaccatgaacatcaccacgattgttgttgtcaccatgaacatcatcatgctgatgaagtctttacaagctggggtaaacagacaccaaaaaaatattcaaaaatacaattagacaacattcttaaaaaattaagtactgatcttacatatggtaatattttaagagcaaaaggttatgttgatagtgatgaagagaactggtggtattttgatctagttcctggagaatatgaaatccgtacaggtaaagctgattttactggtagaatttgtgttattggtgaaaatcttgatcaatcaaaattagaaactctatttgatgaggcagtctaatggatatccgcgtttatatttttacaggatttcttgatagtggtaaaacttcatttatcaatgatactttaatgaatcctgacttttatagtaatgaagatactttattaattagctttgaagaaggtgaaattgcttatgatgaaacttatttaaaaaaatctcacacttctttagttactttagatcatgaaaatttcactacaaatgatttaatacatttagaattagaatttcgaccaacgcaaattataattgaagcaaatggtatgatggacttaaatatctttgttaaagagataattcctaaaaactggttcgttgctcaagtactaactactattgatacaactacctttcctatgtatttaaataacatgcgttctttagtgtatggccaagtattatttagtgatttagttatttttaatcgttatgatgctaatattaaaaaatcaatgcttagaaataatattaaagcaattaatagtaatgcacaaattatttatgaattccctaatgggacgattgatacgatgaataccggagaagaattgccttttgatatcaataaagattatttagaaataaaagatcatgattttgggattttttgtatggatgcgctggatcatcctgataaatatgtcgataaaacaattaggataaaaggtaaatttattggtttagatcgtttggttgaaaacggcttcgttttaggacgccaggcaatggtatgctgtgaagaagatacttcattaattggattgatctgtattggtcctttagctaaaaaacttattcctgaagaatggatcgttgttgaaggaaaaatttctataaattatgatccagaatatcaggtaaatatcccaatcttaactgttggtcaattggaagttgttccaccattagaaaatcaatatgtaacttttgattaaaaaagcggataacgcttttttaatttggaaaaatcttttctttatattattttcaaaatattaaatttactcataattatttttagtatacaataaatactgttattagaataaaggagttaggattatgattaaattgattgcaactgatctagatggtactttattaagagaggataagagttttaataaagaattttatgatatattttataagttaaaagaaaaaaatattaagtttgttattgctactggaaatcaatatgaacttgttaaaaatagatttgatctaataaaagatgatcttgtgtatcttgttgaaaatggtaataaaatcgtatatcaaaatgaggtattatatacaagtatattaaaacaagatgataaagaaaatattttaaatttgttattaggatttgaagatctaatgattgtttattgtgggttaaagcattcttacatctctaagaaatttcgagataaagaagattttttgaaattatttcttcataattatgtttttgttgatgattataaagctattgatgatcaaatcatgaaattttctatagctgattttaatgaagaatctgataaatatgttgatatgataaaagatcatctacctgatcatttacaagctgttacaactgggacgatctggtttgatattttcaataaaagtgttaataaagggacagggttaaaatttattcaaaattattttcatattagtaaagaagaatgtatggcttttggtgatcaaatgaatgattatgaattattattaaatagtgaagaatcatatgcgatgagtaatggaattgaaaaattaaaagcgattgctaaacatatcgctaaatccaatgaagaagatggcgttattcaagttcttagagaattagtttaaaaattgttaaacgttgtagaaaaatctctacaacgtttttctgcctataatttatatttttaaaattttttcaatctttttagcatcattattatctaacacattataagcaactcctccatattcataaaattgttttgaaattcctgtatatttcaaaccatcaatttgcatattatcattaaaattaatggtaagatatcgcccttgccgaactttttctaaagtgcttgtatcactaccaattcctattttctcccaattatcatcatccaaacaattcattgtagatataattttgtatatatcttcaatgtcatttttatcagtaatcgtaatctcacctatttccttttgtaaagctaatcctgcttcagtattgtccatatcagccacccctacaacaatacttgaaatagcatctgctgaagttaagccataaatttcttttaataccatatcataactatatgctgtaaaatccatttctaagctaaaccatggataattagaccactcagattttccctttaaaaaatcattttttacttgatcaaatgtctcatcatcccaaaccagaaatgatgcaaactcccataatgtaaaatcatcaccattttggacaataagatactgtaattcattatgccctaaaagtcgataacaattatctaccccctctaaaggtttgccaagactatctggtaatagttccatccctttagtactaacagttacttgatgatatgttgcaattcgccccattacgggaaatacttgaacatttaatatttcactagaactagtcttttcattcattaaaagatcagacacatttgtgtgataatctattattatttgtgtttgcactgtagattgttcattatttaaaaatctgaacttgtttatacttaatatactaattattattaatcccatagatacacaggttgtaacaattacccattttcttcttggctgatatacttttctttttttcattgatagtgcgtttttcaccaaatcatcatcaatctctccaattgcataaagcagcttttcacttttcataaaattatgccctcctttttaagatataactttaatttttttctcattctaaatagcattaaattaattttgttttcactcatatcatatttttcagcaatttttgaaattggatataaataccaataacgacaaataaagatatttctttttaactccggcaaattataaagaaaatgattaatacattgaatcaaaaatctttcatcaatgacctgttcaacactatccggtgaagagatacaatcttccagttctgtaaaaacaagttctacttgtcctaatccacgcttttttgtattgtaatgcttatatttatttaaagaaatattacgtgtgattttccctaaaaatgctgataaacatttaggtcgttggggcggaattgattcccatgcctttacataggtatcattaacacactcttctacatcttcatggttatgtaaaatattatgagaaatagtataacagtagtgcccgtattttcgatcagtttcaaaaatagctgcttctaagcgtttccaatataattcaatgatttcatcatccttcattacttaacctcctttccctattatttaatatcccttcatctatatagacaacaaaaattagtttttctttcatttttatcatttattacaaaaaatattttacacttttataaatactaaaatgtatcaaaatgattatttaaaaataataaaatagttatataaccaataagtattatcatctatgaaagaagttgatgaatataaatattaaaatcaatatttctaaaattactgtttatctaagaatatatgttgatatgatttatttaatatttgtacttttatctcatttctatacatatcaaaataagcccctgatttactgacaccgatttaaataattgtctttcctacgttaataaacatttcctatcttcatttatatcattcgttataagttctaacaattccttttgatttttatctaataatttatttgtattatcaaaaatttctgtacctacaataaatttatcatattctctatacatcatattttctctttttcatagggtaatctctaaatgttcaaactattcaagtattgatattttattacatacgctagatttcacaatagcaaaaaaagactgattagaatcgctaaaactaccaatcgaccacttttcttactctttttcttttttacatccaatttcagtcccttccaagaacaccaccagtaatatttcatccacaaagaccttgatgtgatctagttttttcagcatgaagttcatatccatttccatcaaaggcagtatcccttgttaagattgatttaaaaaccgctggtacatggaaaatttccacgctccagcggtttattttatagttctatattcatacaatttcctacaactctgttatttaaccttttcgaaaacatatctacattctatacttcaataaaaacattcgctccaaactggtgacaacctttgatttactggcttttttttgataaaaggcaaacagtttcaatatttcccttaatttttattaacaaaactaagccatgaacatataaggtgaatacaaattttcacttttatcttccattacttctatgttcatatactaactctactataccactgttactccttattgtttgaactaaatctaattttatttcattgtcaatctcatcaaaaagcttaataccatttccgagaattattggaataacagaaatatagtacctatcaatcaaatcttcctgcataagctgcttgataatacttgctccaccacatatccaaatatcttttccagattctttcttcaaattttttatcagatcactcggactgttatttacaaacacaatttccgaatttgacagtattttgttatgtgtaataacataactcttcaaacctttgtatacccattgttccggagataattccgtcacaatctgatgataagtattataacctattatgactgtatccaccttatcaagaaacaaggaatagctgtctgtcccttccacattttcatcactatcatattcatttagccaatctacgtttccattttgatctgcaatgtaaccatcaaggctcatggcaatgtacaaaataacttttctcattttctaatcacctacaatcttatgtgtttaccaaaaagggatatcaacatttatatattaattctgagataattcagttcctgtattaccattctgcaaaaaactttgatttactgatcatttctcattagcagacagactgcctctacatggcacaagaggatatattcggtttctccggtattgagtctgtattttatcagtcttaccattaccatacaacacaattcccaaaataatttgtccaaaaaattattatattagaattttaaataggtcagaaaccatctgacctatttatagttcctatgctttatcccaaaaaacattgcctcaatcttactgaagacgaaatcggtattttccttttccatgaccagatactggctcaataatgccgtgttttgtcaattctctcaaaagctcagaagctctaaatggcctaataccaatcactttcatcacatctgaacgtccgaaaattgtttgatctgaaaatttttcataaagcttcaaaatattacttaccgttttaggctggaaaactttttcaatatccggttttatagtttcaatgtccggtttttctgttttcttaaatgcttcactgatgtgcaatgttcggttataaagcggatggttctcattcaacagaagattgtgtaggaaaactccctctccttagaaaagtcataatccaacgttttccgtaactctgtagcacttccgtagagcacggtcgttccattcagcacccattccttctttgtgatgttattcctgcatgagaataaatgccagtaaacagcttcctgtgaatggagatatactcattgggcgtaaaactaaatgctcgctcggacagtagagctgcaatctttgccgaaaccttgtcggcctcttcggtgcaatcctcagcatcgtgggcagggttttcttcatagtagctctgcaaaagtgcatttgtttcatcaaaagatatctcgccctcgatattgcgaacagcagtgcgcatcagatattccgatgtcctcagcccatcaacagcctgtagaccaattgctgtatgccacgcatagcctttatcccatttatcagactcggactctttgatatattcttcaaatgaatctttgttcactctatatctcactattattcttttctccaccagaaaaccgccatttccagtgtttgtattttctctgtagtgttattcggtgaattattttaattaaaataacagctatttagtcaaacaaaaataataaacatagaaaaatagttaaaataatttgataaaatgataggcaaattattttaactattttattattatataaaggagctgacatacaaaaaaagaaagggtcattggatcggttcttactcgcttatgggtaaatgaacttattagacagcacaagaaattgtgctgtttttctttagtttgtatttcttgtttttgggcattttgatacaatatatgtatggatggtgatacatatgaaatataatgaaatcagtttgaatgaaaaaatctttggtaatgacttcattgtctatgactggaaagaatcagataataaaatcataatatatgtgaaagcgacttctcatgatgatgtatgtcctgtgtgtggttctcctacaagttctttacataatacctatcatagaatgattcaggcttatcctgttagaaataaaacaacttttattgatgtgattgcttataaatatgactgtactaatgacaaatgcaatagaaaggttattatgcagaatcttccttttgtttctccctctcaaagaagaacagatgagcttaactgtcttatccttgcagtttctctctttttaagcaatgaaggtgccagtaaagtactgaaacttcttggggtcaatataagcaatgactctatcaaacgcctgactgataagatcattattgaagatgaccctgatgtcgagtctattggaatagatgatgtggcgatgagaaaaggaaaggcttatgcaactgccatatatgatatggaagatcatcatcttattgcgcttttagatggaagagataaggaaacagttgttgaatggctaaaaaatcatcaaaaaataaagattgccacacgtgacagagcaagtgcatacgcttctgcaatcagtgaagttttacctgaatgtatccagattgcagacagatttcatcttcttcaaaatttaattgacagaataaaagatatttttaaaacggaaataccggaaacagtattcataaaagatggaaaggtactggaagaggaacctcaaaaggttccagcattaaaaatcgatccaaattcaaaggaacttgaaaaatatgactatgacaacagtatgccagttgataaagaaggaaatatgattgattttgatgcggtatgttatgataaaaacgataaacaacacagacagcaggctgaaagccgtaaaaaaaacagaaaatgatcattgacattcaaaaaagatgggaggaactcgaaaaaaagaaatacacaacaatagctaaagaattttcaatatcaaatattgtagctaaaaaatatgtaaatatgagtgaagaggatattcaattgttagacagtccaaagaaatacaaacaaagaaaaacagctacagatgactatatcaatatgatctataaaatgatcctggatggaataaagccagaaataatctttagctatgtcattatgaaaggatataaaggtacgtggaagtcattggataacagaattgtatacttattaaaaaataattttagtatttctctttcaatggggtggtatattaagtataaatatccagataatatcatcatcataaaaagaaatgaaatattaaaatacataacaactaaaaatgagaaaacaaagaaaaataaaacagttgaaaaaaacattcaaataatcaaggaaagatatccaattataactgaactagaaaaaatatatgattcgttttacagcacgatcaaggaggcagatactgatcagctagataagtttattgataattatagagaatcagtattaaaaggatttatagaaggtatagaaaaagatattgccccgatcaagaacgcaatatcttatccatatagttcgggatttgttgaaggaaacaacaacaaattcaaactcatcaaacgtattttatatggaagaagcaaaatagtcaatctttttaggaaatgttacataccatttttaatgaataataaagattttaagctaattgatattttagaacacaaaaacagcacaatttcttgtgctgtctaataagttcatttacccataagcgagtaagaaccattggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtctcttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccatgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcactgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaacagtgaaaaaatagcctgttatatgaacagtattattgatggattgacgatagcaaaaggattaagtataataagcgctcatatagcacaataccaagcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattatcataactaattagtcaaaataatggaaaaagccagttaaaataatttgataaattctagttaatataaagtgctaaataacagtattggcttccctttttaggttttagcgaaagctgggccaccaaatcattaacgaaaaaatataataaaataaaaacgtatgagttcaatccttggattaaatttactcctgatgacattgatgaactatctagtttattttcttcagatgaggcaagcgatgtgtgccaaagtcctgtcgaatttgatgaaggaacatattatagaaaacaactgagagatgcattgttatccccaaacgaaacaattatagttccagacggaaaaatggcaggaggcactataaatccagaggatagcaaaaactctcataaatcaatataagtaccagatggagaaatggcttaaatacaaacttcaaaaaagagactttgcgatagagaaaaaatcgacaaagaagaagcagaggaaaaagtaaaaataagaagagaaaagtcaaaaccaatggtagatgacttcttttcatggtgcgaagccaatcaaaacaaggttttagcccgttcaaaattaggcaaagcatttcaatatgcattgaatcatgaaaagggattaagagtatttctagatgatggagaggttccattgacaaattcattggatgaaagagcaataagaccatttacagtaagccgaaagaactggctctttaatggatcaccaagaggagcaagagcgagtgcagcaacattttcattagtcgaaacagctaaagcaaataacttagatgcacatgattatatagaatatttattagaaatgatgccaaatgaagatataataaatcatccagagaagttagatgattatctaccatggagcaaacaaacaaaatcagaatttagataaagtgataattaatctatcatacatgattaattatcgctttttaaatacactatattatttaccacttacaaaaagtatgagtaactaaataaattttaggtttttaaaagcactcaagtttcttggagtacttttttatataagaatcttacagcttttattttatctagggtattctctatttatattttttaggttgacccctaaattatttggttagcctgattgccttagctttaacaatcaccttatcttaattcaatgatatttcattttctcttaacttaataccattgctataaatctgtattttttattttgaaagctcgctcaaattgtttttaaataaattgtaatatgtttcttcaaactcggttacttttaatattctatccaaattttttttgtgaactttatctaccgaatcatcttcattttcttcattcccaacatcatacacttgcaagcctgaactaatatcaataatactttttgtaatagtgtcaatcacatcaatcaattttataatctctttctgttcatcatccgaaagcaaataaccatgcttttgaaaatgtgaatacataattttcatatttatctctgctgcttcatagatttctgaaagtccattttcttgaaaatttttttgagaaggtaaatttataataatatgccttaaaagtttttcctctggtaatacattgagcaattcggcataagcctctctcaatcctttatatcgttcttgatttacagtgaatttttgcttgcttttttcaagctctactaaacgcttattattcttaaatgcaataactaaagaaaagatacctgcaactaaagatgctattacacctgcagaaagcaattctaatataatagtaattctgttatccatttttctctcctttactcacaacaacttccctaatatatatcaatatggcactaagtaaacagaaaaatagattccataaaagtgttttgggaaaagtctttttttcctgcttatttaatgtgttttccaaaagagtatttaaggcattcacttattcttgattcatggccgttatttgttggctaatttctgcttcctgtttcatctgttcaaacaacttttttctcaatttcaagtagtgcattttcaataatttctttagaatcttgcagattcttgctaacagaatcaatgcttacacttattacattatcttctgatgtctttaagttctctttgtttaggcttgcctttatatcttttaagtttactcctaaaaacgatgaaataactgatataagcacttccaatattgccgcattcaatttatcccctccacaatatattgcttattatttcgctggacttgttttattttttcaaaatacttataatatcagctattttagggtcataatcttccccagattgatttctaaacgatgtactaccattatctatattccaagaactaaatgctttcagtacttcttcacgagatgcttctgccccgtatgcatccaaaaagaatttaccaaaagaaatggcgtgtatcctatctgagcatcttatcgcttcaaccataaaggatttagcaagtgtaaatagtaatttagataatgaaatcaatatgataataatgaacaagcaagtaatgccatatgctatcatatatccaatattttctgtttgccaatctctatttgcgacaaaaataacggtaataacaatcgtagtaatcaaagaaataatcgaaactaaatatagccagaaggcaaattttttatttcttttttcgctttctttcaaattagtaaaaacatcctctatgtactttgataagcccgtctttactttttcctcggattttcttcgttcttcttcaccccgctttattttctcatcatgtgccgcaagaattagtctcattttttcaatagcatctttctctaatggcttgtctaatcttacttttggtccatgcacaccatattctattgacaaatcgttactattgtcctctttattctcatatggaataacaatataattaaacctatttaggtctgctggtagtagagtgtccttccctaaaactacaggtataactaacggtattctccctttgcctaaaaatgacaacatggatatagtttcattcgcaacaaagtggcttccattagaattttttgaaatcacaacaattaccgcatcagcctttgcaattcctttaccaatatctttgtatatgttgtttccaatgggaattttgttgtcgataaatacatcgtagccatcggcttctaacgctgatgacagtttaaaggcaaattccttgtctatatgcgaatatgatataaaaatattcatataaaccacacattcctttccgcctgcgtctccaaggcacacatagccatgaataaaatcttgtttgtgcaggcattttattttatattcttactgaaggaatcttacactacaaagacgggaaggcgagttgtagatttctgcagctcgttcagtttaaaacagtatataaaccagtgcagggctgagcttttcaagcacacatgagtatgtcttttaagtctgtatgttgatatgcaaattattttaactcaaaaaactactgtttttgcattcgtaaattagctaaaattaaatataactaattttatttaacaatattttattcaaattaatttgattgtttgtatcattatattttgctatttttaactaattagctcatatctattactactgttatctaatttaatttgctaaaaatttgttaaaataatatgctaatctacaaactggggttacaagtctatcaattaaatatcactttattgtactactacattaaatccgcttttcttagccttttcaataaatgccgactcaaatctcgatacctcgtttttatcgactataattgttaaattttttctagctcttgagcatcccacataaaataacctataagcacttaatactccatacactgaattctctttcagacattttcttgcgcttgttacaccaggttttgctaagtatttatcaaaatctaattgtaaaattttattataatattcacttttcgaatattcttccgaaaattcccttatacttgaatgaattttctcttttttcttttcataatcattctttttcatatcagaacacttcatccccatatcctgctctatatcttttataaaatatttgtagtcataataaaacttttcaaattccgataaagagacttccatagaactccacaatttaaaaaaacttgtcatatgtactgcaggattattattgctatttccggccataaaaataactgtgtcatgactttccccttttacaccatgttgagtagatatatgtggattataaagatgatctgcaagattgtgaaactctcttatttcggtatttaatataccagcatattcttccatatttatttcatctatatattctgtattcactacttccgcttcttttatctgatttataaagtttccaattgttgtttcgttgccatcaaatttacacaaaatattttccaatatttccttaaccgctcttttattttcatgttgctttataataaattttgaaacattgaaaatttttttgtttgccttaataattcttataacactaccataaagtccttttctatattctatatcaatttgtttaaacaaaaataacataaaaagcagattatctggattattatcatccatattagttaatacatcaattactccatacttttttgtatatccatatctatccatgctataaacagcatcatacaatgtcccagcgccaatgctataaaaacggctcctattatgcaaatacagtacaagtgcttctgaaaattcttcttgcttttttaccaacacatcttctgtagaagatgtaataattatttccggaatataactcatatcctcatctttattttccgtataaggaacttgttcatattttttatcattataaatctgattcaatatcgatactattctcggagttgttctataatttacctttaagttaaatgttttatttaaattcgaaaattcactttcaaaacttccatcataagttttataaatctgttgcattttatcaccgagtagatacatttttccatttgcatttttcattgcgtcataaaataaatgtaagacttctgctgatgtatcttgatactcatcaataaaaatcaactgatacttatcgactattttcctctttataaccggaaacttatctacaacttttttggtaaaagttatcaaatcatcatgtgataatgcacctctatatagcgaattatatggtgcctcattatatgaaattgaatcaatattattataaacagtttctacatctagcttgccgtatttttcaatatatcgttggttactttcttctatattatcttttccttctacgttatcaatccgttctcgaattcgttctttatatgtttcccaatagaggtcaacaactgctttatgagaaaaaaagctacttataaaatggttaataaaagaatgaattgttccaaaaaacactttactgctgtcaatatccttccctagttcttcagcagctctattagtatatgtaatgcataaaatattgtcatctggataatcacgtaaatgtttttctaccatttttctaattgttgtagtttttccgctcccagctggtgcatttactaaaaaaatattattatttattccatcaaccattttaatccctcacttatatacttcggttgcatcgctgaaacataattgttcaaaataacagaatacataaaatctgttttattacctgaagacgaatccaatatatctctcaaatagaattctgaatcttcttcatctttcttgtttcttggaatagaatattttaatttcgaagtctttcttttatcactccattcgcttcgttttaagcactttgtcgcacttattttaaaatacttactcaacattgcctcttcaagagttcttgcataaccatcttcggaagtctggaatgataaatatatcctatcttcatcgaatatatttttcttattcttcttccaatcatacaattgttctattgttggttcctctgcgtccgtttctttataaaagctattaattgtagcattggttgtctttgactttttaatattatcttcagttaccgcatctttgtcatagtctaagtcagtaataattaatgtttttattttcaatagttcaatcaattttcgataattatacgcatatgctccacctacttggatatatgctatgtattgttggcttagtttttcatattcaggtaaagtcaataactttctcactaacaatctttcagtatcgccttcatacattattaccttgtctgcaaaaacaatttcagaatacccaatttcaaaaaaccaatcaaaaaagttggctaacccctcatcctccggcgtattttttgctcttaattctttgacaagtaacgatggattatacaagtcacatttaaacttttgcatttttcgaatcactctcaaatgcgacatcccagcaacacgtaccatatcatttgaatgtgtagttataactccctgtaatcgcttttctttataataatccaatagatatttgataaacacttgttgcatttgtggatgcatatgagattctggttcttcaataaaaaatacgtttacctttagtggattcatgcttttctcatattcctttaattgaagatgcatataaatcatattactataccccaatccttgtgatgcttcccctaaaaaatatccatcgaccttataagttgttgttgtaatacgttgtaacaaattactaatatcatcttctgtaacgttcatatcaagcattaactcaccagtctgtccgccatttgttttttctaatgctgtaatagtatcttttaatgaatttaatgatgtctctcttactgttttatcaatttccctttcctgaattggttttaataactcatctggtaacgtttttatcagttctttccactggtcatccaacttagccatctttatcatctgtttactcaatgtgtgtgaatgatctaaatcatcatcatctaaaggtctgcttgcttttatatacgtaaaattaaataatcctctaagttcactcacatcatccattttacatttattttcataagttttatcacagaaataacacactggcttaattgcatcaatatatattttcaccaacagttcttgcaaatatcgttcctttaattctttattaggtccttttaattcattaaaacgtttttttagtttatcataattggttaatatatatttactaaacaaatgtctatttacttcatatcgataaataaaataaaaagaatgttcattttcatccaaatccataatataatctgcaaataattttatatcatcaaattcaacattataatctacttgaatttgaacttctgttgttttaatttctattttttctttcccttcgtctgcaggtaatattttgtttagtaactctccttctatatcatcaacactctttccatttataaaaaacactttaaacaatggataaactttatcaatccattccttcatattttttgctggtatatcagcttctccatacagaaccttctcactcgaaatcatatttcttattaatgtaattaacgatgtctttccactattatttgcacccgccactatagtgacatcatcatcaaattcaatctccacttgttcaaactgacgataatcatttacaagcatctttactaatttcatcaagcatccctctttcctctcaattgtacttccgtactactttatatccattgttttacttgtgcttttcatcattacaactgtaattttctataattctctattgtcctcacgccatttcttgttttcttctacacatctttgaatctcttctctagaacgataatatgttggaaataaatcattcacttctttaatacacaaaggaatctctatatcagccaaatcatcataattacaatctgaataatatgtaatatcaactccatcatattcccagctatctgtgggatcaaagtataaaataaatcctaaaggatatgccgttatctcactaacaaccattgatttccaagcatcatcatccattttaattatgactgataatggtgcatatttcattaaatgacttttcgtaaaatacatacaaatcttatatttcgttttatccaagcttctctctgttttatttaaaacaaaatcccttaatacatctatccttgaatcttcaaaattattaatcgaacaaaacatagaaagtacttgctttatgaaacgcagtggatacacctctcttatctttatcccatttatattatcagaaatagttttcgccaaagcttggtgaatcacatgagaaattaaattgtaatcgtttccataccacgccccagtattgttattacattctttacataaactatattttcccattccccgctgctgatttatataatgaagtcccgatatttcccaaggcatacgttcatcatctttcattattttatcaccagataccggtttaaccggtgttgagttaaatgctgttctaggtggtatatgttcaaatgttaattcacactcttttctacataaagcacattttcctcgaggtcttttgcccattatatcactccttaaactagtacatcctttctatattttttcatcatactggaacatcttttaaaaattgtaaactagttacaaaaaatgcttgtcctatcaacgaatctgtctatgttaaaaaaatttctcaccagactgccaactcctgccatgatatataaactctctctaatttcttatatctccccactctatatcaaccaccaccgacacattgatataatccttaatctctttattcctcatcttctcaccctcatctgtaaacacaatatgtttatgaaagtgcctaaaattaaggatttctacatatcttttctttgtatcgacactatagtctctatatgtgtagtatggggaaacatatcaactggatacatgacattactacgatatcctagttttgcaaaatacttgatatctcgaacctgagtacttggatcacatgaaatatagacaactttttgaggacttaaaatctttattgcatccataaattctttagtgcttccgcttcgagggggatccataatgatgcaatcaactttttgtttttgcttagccagtttaatcataaaagctgtggcatcatcattaacaaacttgatattactaattttattcatcttagcattattgatggcatctttaacagcatctttgtttacctctactccaattacctcttttactttacttgaagcaatcattccaatcgttccaattccacaataagcatcaataacaatttcatttccttttaaattcaatagctccaaagctttatgataaagtatttcacactgatgatgattgatctgataaaaagatttcggcgaaatcttaaacttcaaaccacataattcatcaacaataaaccccttaccataaagtaccttttcatcattacctaaaacaatacttgtctttctcttattaacatttaaaacaactgttttaatactaggaaagctctttattaactcattacaaaaattcttagaccctttaaatacattatcattacaaaccaaaactaccattgtttgatcgctaacgattgctctacgaattaaaacatgtcttaacaagcctttatttcgattctcatcataaatactaactcgatatctttttaataaactttgaattttctttataattaaatcacttacttcttcatgtaataaacaacgatcatagggaataattttatgactatcttcttcataaaaaccaaattcatacttttgattaaaagcaataattattttattacgatactcatagggatgttccatccctaacacatcttctacatgatacatatctaaacgattgtcttttaagagttttttacaatactcttttttgatatctaattgtttttgataactactattaatatatttacaactgccacatttcttttctattaaacatttcatcttatcacctaaaaacagtataacataactgttactattctaaagctccttttactttttttctagtaaaacaacgttcttcacgattggctaaagccttgatccgagcatctaaaagaatttttctaccattttcatttctcgtataaataacctcatatttgccaataaatggtttcatatattgtgcaaaaatagttgcatcttctttccttttagaaaaacaatcaggtatagcaaaataaccgtctaatttattcctacgttttggattataaagaatatatcgctgattatcgatcgaagcaaaaaattcactaacacattttgcaaataaagctttatcatgtccagttccaccaagtaggtaaaccgcatgtcttactccataagattctacttcaatacgactattataactgtcaagctgattggttttttctaaagcttctctaattcctttgccaaatatatttaaacgtgccagcggattttttaaagtaagaactttttttaaagataataatattcctaaagaaaatatcgcgatatatcctactgcaaaaagatatttttgaattgatgataacgatagatcttttaataaaggtaatcctaagattactccaattattccggctatgaccattatgatcaagactcgtaaagcatcattaaataatactactgatatatatttatcttttactttagcttcatcaacaatttcaattttttcatatacagctagagaacgttcccatctatcttttaatgattgtcgctgcttagataaacttaacatttcctgattgatctttttaacattgctttgattaaatggaaatttaattgctgataatcgttcgattccattttcaatcgtatcatgtcgatagtgcaatcctaaaaaatgttccatccgtcgtgtcaacatttcaaaatcttcactactattatcaacttgtaaattatctcttggttttacacaaaccaaatgccaaatattactagttttattaggatcatccttaaatatcctgattgctctgccccgcatttggttactcaacatataagagcctacaaaacttgctaaaatcaaagtattaacacatggacaatcccaaccctctcccaataatgatttagttccaattaatacctggatatatccttgagtaaataattcactaattatatcaattaaaaaatgctgatttcctttaagctctactttaacataatcttctaatttaccaattttaataaatataattttattagcatcatttatctttttaagcagtacttcttttgcttcaattggaataataactatactgccacataaaacacctaactttagcgatttgctttctcttcttaattgttcaaaaaaaggtatcacacctaaattattaacatctttagtttcatctcctaaagaactttcgtactcttttcgaatataatctgtaagaatcaataatcttaaatcatcctttaaattttggtattcatgaaaaacgatttgtttaatactttcacattttccttttgaattaatcaatatcttttcaagagcctgattaacttgtaaagtaacttttcgcttttcaatcaaaccttttgcctttaactcctttatcatctgctggcgataattttcatcaactaaatatgaatcagtatcatcataaataaatccctgtaataatatttccagccatttcaaagttactggttccaatttcttaaaacctaataatttttgaaatcgtttagatacaggaattttaccctcatttaaaaaaattaatagtgacgacaaatacgctggattttctaataactcctcatcacttacagtacttgtaaaaaaacgatgagcttgaatcacctgtaaaaattgctgatcattacataaattatttaaaatgctttgggcattttccttaaaaacatttacttcctgcttttcttgattagttggataattaaaataaacataatcctgatgcgggcacaatgttccatctttaactaattctggtactgttatctcttcatctatctcaccacacatatccatataacgagtccacatatttatatttgcatcatatggcggtgtagctgttaaagcaattgtaaaaatattatcaaaagcttttttaaatttttccaatgatttccaccattcatttcttaaatgatgacactcgtcaagacataatgttcctaattgcagacttttaaaagtttctattagatcaaaatcatcataatcaacttcctcaatcatctcaaactcatcattttcttcaattaattttccctgatatctactcattgcactaaaaagtgcttgataagtagctactgtaattaatttaggatattttaaatctcgagatatatatttatcactaacagcttcattacataaaaaagctttattaattctatctatccattgttctctaattgtaattgtaggtgttaaaatcaaagtgatacgattagtacgtttaataagttcaatccccagtgttgtctttcccgaacccggagctgcaactacatgaattttgtgatcttgactatacccagcaaatttatcaagaactttttgttgatatattcgccaagttcctttaaactccaaaatatcatcgtacataagctatcctccataactattaaatatcatcctcatttaaaatctttttaatatacattgctaacatatataacattttttcttcaaaagtatctaactgacatcccagcagctctttaattttaagcattcggtaattaatagtatttcgatgcagataaagattcttagccatttcaatttgactttcattataaaacaaataataaaaaagtgttttttctaattccccatgatgtttttgatcatactcaataataggctgtaataaactgtgatacatttcactaagtatttgtttatcttcgattgaaaaaagaatttgatatatccccatttcttcaaaagaaacgataggtaattgaaactgtgtagccattgaaactgcagcacgagctcgcttataacttaaaatcacctgtctaaaatccagcatttgactgccaatacctaaatgaatatatttaccttccattctttttttagttcttttatacattttatcaataattctttctagattatcaggttcaagattatttacaactaaaacaaaacatccatcaaaccagaaaaaagtatagggactttcaattttttcaaaacataattctaattgaaaagcaatctttcttctttcaatagcatcaaactgatcagaatcctcgatttcaattaacactacttgaaaataaccatcaacatcaaatgaactcattaactgtggtcgtacttcctcaactgtttggacagtcgtaaatacttcttgaaataattttgatatttgttgatcttctctttctgaaaataaacagcgcatactaaaatctttgatcaaatcagccatatgaacttcccaaggtgttgttaataacgggaattcttgctcattacaataatctataatatcttgagaaacttcaaaaatatacttacctgtattaatgatcagcccgacactatgatatttaactaaacatttaataaaatcaaaaagtgcatcatgactttgaaaccctaatcctgtcgttactgctaactcttttccccataattgttgaattattttagtatcctcgatcatatgaacccaactcatcgtattgctacaaccttcttgacctgccaacagttttaaatgatactgatcttgagtttgaaccaaagcatcttctatcgtaaaccccattttttttcctccttttttctattttatcattatttgtgcacacagcacaaatattaatgatttttttataatgtttgtccctaggattattaaaagattgttatataatattattgtattaagaaaagaacatttaggagggacattaaatggatatttatggatattttgtaataactgataattttgaaacttgccctgcttgggttcaaagtgaaaattatttcaattgtgaaaatttttctagatttttcagattttttaaaaaaagataatatatttcattataagccaaaaacaaaacagaaattctgttttgttttatttttatagacagattatcctcacctttaaaattttcaaagaacatgattattaaaatcagtaatcctagatttaatcttctttacccttataaataaaagatattttaaaacacacacttttaaatattcaacatttcttaaatcaccttaatatttaaaattaaaaatcctaattccctatttttctaactgatcatataatttactgtaatgtataactttttacaaacggtataatcatcttcactaaatactaagcaagaaaaattttatacatgatattcttgatttcttcatatgcagtttttatagacatattattttctttttctttattctttttgttcagcgggttcttggtaacgaagcacttttgctggaacgcctccaactactgcatagtctggtacatcttttgtaacaactgccccagctccaacaacagcatattttccaatcgttaccctaggacaaatagttacattcatgccaatccacgcattcttttttattgttacttttccataagtatatatataatgcctagcattcatatcatgattgatcgtagcaatacgaacccctggtgcaatcattaccccatcttcaaattcaattccacctgaagcagataaaatagcagagtgattaataaatacgtttttaccaaatttcaccctatttccaaagtcgcaaataaacggtgtaagtattcttatatctttaagttctcttccaaataattcctctaagtatttaagataagatgaatcattaggtaatatagcatttgcctttgcacaaagagtcctagcacgaagcatctcatcacttgcttccttgaaatattcttcacgtgcatctgttggtccaccttgatccattaaatgataaatatagcctttcttatacttcatttgatatccacctttcaattattttttgtgcattatctacagcgcttccggttattgccagtccttttgtaacttttgcaccttgagctgcatttctaatatctttttctgttgatgaaagtccactaccttcatgggtacaaaaaggatgtattatttttcccgtaaaattaaattcttctaaaaatgtatatactgccattggcatagtttgccaataattaggatatccaagatatatttcatcatattgttccaagttatctaacaagcccacaagttctggtctggcatttgtttgcaaatctttttttgcttctttaatacaagtattataatcttttgcataaggtttcttttgttcaatcttaaataaatcagcacccgtgatttttgaaatcatctttgctgctttttcagtattaccaatagttacgtactttatagagccaccaaaataattttcatcagctctcgaataaaatgctacaagttttttcattcattattttctcctttgtcccaaattaatttaccagtttttaatgctttttcataacgagaaattttgtatgaaagtctatccatcgtttcttcaatttgctctttttgaaatctcaaaacatccatttgattattaagaagttctaaccttgcaggaatggtattatcgccctgttgaaatagttttacatactcaatcataacttctatcggcaatccagcatttctcatacaaattgctaattctacccatttcaaatcttcttcttgataatctcgtattcctccagatgttctagtaactttcggaatcatttttactcgctcataatagcgcagcgtatcttggctgatatgatacttttctgctacttctttaattgtcactatatcatctccttttatcgtaaccatactatacaacttggagtttactctaagtcaagactttttatataaataatatatacatagtttatcaactttctttcaaaaaaacagagatatcaacattagttggtatctctgtccatgactcactcatttattatatatatgataaaatattctttgattcgtgcaattttatcttactgaactgcaaaagttaactctgctttacaaacaactttgccatttacttttgcaactgcatcaccaattccaattggtcctttttgttttgttaaaacacattccatttctaaaacatcaccaggtgttacttgccctttaaatttacatttattaattcccccaaagaaagcaatcttacctttattttcttcctttgaaagaattgcaatacatcctacttgagctaatgcttcaacgatcaaaacccctggcataacatgatactgtggaaaatgtccacaaaaatgcatctcatttacactaacacattttattcctttagcccactgacctggtttataatcaataatacgatcaaccaaagcaaaaggataacgatgtggattgatttcttgaatttgattactatttaattccattttcttattctccatatttcttaaatacgatcgtagcattatgtccaccaaatcctaatgaatttgacatagctacatttacttcttgatctctaccagtatttggtacaatatctaaatcacatagtggatcaggtgtttggtaattaattgtagccggaataaaaccttcttcgattgcttttacacaaataacaccttcaattccacctgcagcacctaaacaatgtcccgtatttcctttagttgaagataccgcaacacttttagcagcttcacctaaagctgttttaattgccatagtttcccctttgtcatttaatggcgtactagtaccatgggcattaatataagttacatcttcaggttttaaattagcatcattaagggcattgatcattgctttagcaccacctgaaccatcttctaatggcgctgtaatatgatgcgcatcacaacttacaccatagccaaccatctcacaataaatatgagcaccacgagctttagcgtgttctaattcttcaagtacaataattccagctccttctcccataacaaagccacaacgatcagcatcaaaaggaatagaagcacgtttaggatcattattatcacaaagagctttcattgatgaaaagccaccaattccaagcggagtaatacttgcttcagctccaccagctatcattatatcttgatatccatcacgaatatttctaaaagcatcaccaatagcattagtaccaccagcacaagcagtgactgggcatgtacataatcctttagcccctaactcaatagcaatatttccagctgctaaattcgtaattgacattggtacaaagaatggcgaaactcgatcatatcctttttctaaccctttagtatgatctttttcaattgttgcaagtcccccaattccacttgatactactaccccaaaacgatcagcatcaatttcttcaatatttaaagcagcatctttaaacgcttcttttgcagcaattaccccaaattgagtaaaacgatccattttacgaactgcttttttatctaaataatctgccggattgaaatctttaacttccgcagcaattttaacttttgttaattctgtgtcatagttagtaatttcagcaattccacaaactccatctttaatacttttccatgtctcattaacattatgaccaatagcattaattgccccaagtccagttactactactcttcttctttccatcatctttctccttacattgccattccgccgtcaacatgaatagtttgaccagtaatatatctagcatcatcacttgctaagaaaacaactgtattagcaatatcgctcacttctccaaaaactcctaaaggaatttgtttggccatactatctttaacatcttctggtaagacatctgtcattgctgttttaataaaacctggtgctacagcgttaactgtaatcccacgactacctacttcacgtgctaaagacattgtcatcccaattattccagctttactagcagaatagttgacttgtccagcatttccagctacacctactactgaagacattgaaatgattcttccatagcgctgtttcatcatgatcttagtaacatgtttcatacaattccatgtaccttttaaattaacatcgataacagcatcgaaatcactttctttcattctcatcaataaaccatctttagtaattccagcgttattaactaatacatcaacgcgaccaaattctttcatgatttctttaaacattgcttctgtttctgtaaaagatgcaacgttggcttgaactaacataactgtagtcccaagatcttcaagttctttttttgttgcctcagcaatttctttattattaccgaaatcaacataattaacaaccactttagcaccttcacgagcacaagctaaacaaatttctttgccaattccctgagctccaccagttactaaaactactttatcttttaatttcattttattctccttttaatccagaaattgttttatttaatgattcttgatcttcaacttgataagttttaatttttttatcgattttacgaataaaaccactcaataccttaccaggaccaatttcaataattgtatctacaccattttccaacatataacgaatactatcttcaaaatatactggtgacattacttgtttttctaacatttcagcaacacttacatttgcttctaattcttttgctgaactattaaaaataaccggtatttgcatttcattaaaagttatatctgtaaatttttctttaagttcttgactagctggtgctaataacctggtatgaaatggaccacttgtattcaacggaattgctcgacgagcacctttttgtaaagctaattcacttgctttagtaaccgcattagcctcaccaccaataactaattgtcccggacaattataattagctattgatactacccctaaatcactttcttctgcaacagcttcatccaacaattcacgatccaaaccaataattgcaaccattttactttccatttccattactgctcgttccattgcttgtcctctaaaacgaactaggctgattgctgtttgatcatctaatactccagcagcattcaatgctgaatattcacctaaactaagtcccgctacaaaatcaggatcaattccattttcttttaataacttagttgcaattacagcaacagttaccatacatggttgtgtattgcttgtctttgaaagttcttctatcggtccttcaaaacacaatttttttacatcaatatctaaatcaatattatcaaaaatatcttttgcgatttgataattatcatagaatgatttacccattccaacaacttgactgccttgaccagcatatacaaatcctatcttccccattactctagtccttccttcaactcatccatcaactctttgactgaaattatcttatcattacggtatccattgctgccactaaatactaacccttcatcaagattccctttagcagcattgatcaaggctccacttatacaataaggtgtcgtctttacgtcgcagggaatcaaacaattataacatctttttacaggtattctttcatcatttttcaacttttctgtaagttttgtcatgattgctctacctggcattcctaccggtgattttacgatttcaatatcttcttttttagcattgataaaagcctgcttatatttaatatcggcatcgcattcatcagtacaaataaaacgggttgccatttgaacaccatctgctcctaagtctaaaaactcttggatatctttactatcataaattcctccggctacaaaaatcggaatttcttttttatacttctctacaaatggttgaattgcttcttttacttctttaaagatatctgccaacttagccgttgtcttatttaatacatcttctttatgaaaacctaaatggcccccagcttcgctaccttcgataactacaaaatccggtgctactttaaatttacgatcccatgtcttacaaatcaattttatcgctttaccacttgatacgattggtgcgatcttgacctttgtatcttttacaaaactaggtaaattcattggcaaacctgctccagaaataatggcatcaattttattctttacagctacttcaaccaaagctgcataatcagtaatagcaaccatagcattaattgcgaccatacctttaccttttgcaatctctttagctttttttatttcattagctaattcacgtttattagcttcgagcgtatttttctcaaagtctgctgcccgataaccaggatgagcagttgaaataactcccatcccgccatttaaagcaacatttccagctaagtttcctaatgaaattcctacgcccattcctccttgaataattggaacctcaaggcacatctcacctatgtgtacttttttcatctttaaaactcgctttctacccttttaaattcttgtttacactcatcaaacaattcttcaataattgctgctactggttttattttatctaccattccggctacttgtccagccattaaagaacctgtttctacatccccttctaatactgctctttttaatgaacctaatgtatacttttcaagttccatcatatcagcaccttctttttcacgcttgatatattctttagccattttattttttataattcttactggtgttccggcaattcttccggttactgttgtacttgtatctttagcactgatgattgcttgtttataattttcatgaattggacactcttcactagctaataaacaagttcctacttgtactccactagcacctagagcataagctgctaaaacttgttttccactagcgatcccaccagctgcaattacaggtactttgactgcttcaacaacttgaggaactaaagccattgtcgttaattcgccgatatgaccaccagcttcagtaccctcaacaataatcgcatcaacatcatatttttctaaacgttttgctaaggcaacacttggtacaactggtaacactttaattcctgctgctttccatgattcaacatatttaccaggatttcctgctcctgttgttacaacgggaactttttcatcaattactaattgtgccatttcatcagcacatggattcattaacatgatattgactccaaatggtttgtcagttaagctgcgacaaatttcaatattcttttttaaagtttctgtatccataccaccagctccgattaatccaagtgctccggcattagatacacttgccgcaaactcaccagttgcaatattggccattcctccttgaattaaaggatactttatgtttaataattcatttaatttcattttttaactccattctattaatgtagcgccccaagtaaggcccccgccaaaaccaacacaaataattttatcgcctggttttaacatctgtttttcatccatctctgctaacgctaaaggaatactagcagcagaggtatttccatattcttgtaaattcatataaaacttatcttcagaagattttaacttcttatatacatttttaataattcgataattagcttgatgacatacaacatatgcaacatcatcaagagtcagattgcttttctttaaaactgcatttatgctttcaggaattactttaacagcaaatttaaatacttcctgtcctgccatcgtaaggaaatgattttcacttacttcattaattgctggtgccttcaaagcatctaaattaccagcagaattgctgtagctagcaaaaattccttccccattactaataactagcgctcccgcaccatcaccaaataatacacaagtattacgatcgttgaagtcgatcattttggatattttttcacttccaattactaaagcatatttatcacctaagttttgtaataacgcctgagctactgttaaagcataaacgaaaccgctacaagctgcatttaaatcaaaacacattacttcttgatcgtttaatcctaatttttcttgaattaaacaagcattactaggtgtgaaatagtctggtgtcatagttgcacaaattattaaaccaattttacttttatctatattttttattgcttttaaagctgcttgatatcccaaatcgacacaactttcttcctttgcaatatgtcttctttttattccagttctagagacaatccactcatctgatgtttcaaccattttttcaagatcgaaattatcaagaacttgttgtggtgcatagtaaccagttgacaatatttttaatccattcatataatctcctaatatttttccttgatatcttcaaagaaataaaccagctgctgtaatgatttaatcaataattcatcatcaagaacatgactatcttcacatacccgactaaccatttcttcatgaaaatcacgatgaaccttacaaacacgattacctttaattgttaattccactcgaataacacgacgatcattttcatctttatgacgctttacataccctttagcttccagcttttttattgctgtcgtaatcgttccattcgttaaagttgcctttgaagcaatcgttgacatcgtcggatttgataaagaactgattgcatcaataatatgcaattctgacaaacttaaatcttcaactccatgtcctaccatatactgtgtttcaatatccattatctggttaaataatctaacaaacaaatggttgatcaattctcgatttaaaatatcgcgattagtcattcgtaattcggcccatttctctaaatttattatagcgtttagttatcaatgctgtttttgataatttcattaattcttctaaattattacgaagatatattcttaaacgcttatacacatattcacgattttttgtaattcctccgcgaggttctttgataattttatcaattattttcatttcatataaatcatcagctgttaatttcattagctctgctgcttcatgaacccgtgtaccatccttatctttccacaatatcgatgcaaatccttctggtgataaaactgaataaacactattttccaacatcaccatgcgatctccgatacttagagcaagagctccaccacttccgccttcaccaattacaacaacaataattggtactgttaattgtgacatttccatcaaattacgagcaatggcttcaccaatgccatgtttttcagctttaagtcctggataagcaccaggtgtatcaacaaaagtgataataggtcgattaaacttttcagcctgtttcatcaaacgcattgcttttcgatatccttctggtgaagacattccaaaattgcattttagattttcatctaaagttcgcccttttaaatgcccaactactgtacaaggaatattttcaaacattgccaatcccccaacaatagaaccatcatctttataaaaacgatcaccatgtaattcaataaaatcatcaaaaagattttcaatatattcatacacgtttggtcgatcagattttcttgctagataaacacgatcataagcactaatattttgataagcttcattttccaaacgagctttcgtattttctaaatcttgaatttgtaaagtatgatcaatttcctgatcatcttttaattttaataattctaattcaatttctttaatttttatttctttttcctgcagtgacattattgcgcccccctgctatgcatttttaataatttaataattgtttctcgcatttttgaacgttccactatcaaatcaataaatccttgatcttgcataaattccgttctttggaatccctctggtaatttttgtttgatcgttgattcaattactcgaggaccagcaaaaccaattaaagcttttggctctccaataataatatcacctaacattgcaaacgaagccgttacaccacccgtagttggatgcgtaatataagaaatatacaacaatcccgcttcatgatgtttagctaaagctgcacttgtcttagccatctgcatcaaagaaataatcccttcctgcattctggctccccctgaagttgtaaagataataatcggacacttacgctttgtagcatgttcaattgctcttgttattttctctccaacagcacctgacatactccccatcaaaaagcgtgaatccattacacaaacaacaactttttttccaccaatttttcctgtagcacagacaaccgcttcgtcaagattagtcgcttcttctaatttttttaatttttctttataaccaggaaacattaatggatcattagatttaatatttttatataactctttatatctagctccatcatataaaagatttaatcgtgtataagcacgcatttttaaatgagctttacatttaggacaaacataataattttcttttaagtcttcacttaaaatcgattccccacaattttcacacttagtgtataaaccatctggtatatcaattctttttttatcttgtaacttatgacgaattgatttgaataaatttaatttttcttttcgcgctctaaataattcttccatttactatctcaccaacttatctaagttattttcaataaaacttgtatcaaaatttccttttacatattcccctgtatgcaaaatcaaatactgtaattcttgattagtatcaataccatcaataaccagctcagctaaaacccttcgcatccttctaattgcctctaaacgattagaaccatgaacaataactttcgcaatcattgaatcatagtgtgatgatactttataaccttgatacaaagttgtgtcgattctgactcccagtccgcctggtaagtgcacacttttgacagttccaggacaaggtctaaaaccttcacggggattttctgcattgattcgacactcaattgcatgaccattcaaatgaatatcactttgcttatatgttaatttttgattagctgcaattctaatttgttctctgatcaagtctattccggtaatcatttcggtaattggatgttctacttgaattcgtgtattcatctcaataaaataataatttccatcttgatcaagaacatattcaattgtccccgcattacgataaccagctccaacagctgctttaacagcatcttctcccatcttttgtcgtaataaaggtgttaaagctttgctaggtgcttcttcgatcattttttgattacgtcgctgaatcgaacaatcacgttcccctaaatgaataacattaccataattatcagccaagatctggaactcgatatgtttaggatttaaaatcaatttttccagatacatatcatcatcaccaaagcatgctttagcttctgctttagcagttaaatatgcatcatcaaattcttcttcgctaaaagcttttcgcattccacgacctccgcctccagctgatgctttaattaaaactggataaccgatttgagtagctatctttttagcatcttcaagatcattgacgctgccatcacttccaggtacaaccggaaccccagcttcgatcatcttttgacgagccatacttttatttcccatcatgtcaataacatcaccacttggtccaataaatgtcattccacattcttcaactaaacgcgcaaaagtcgagttttcagataaaaagccaaagcctggatgaattgcatcacaacctagagctgttgcagcacttaaaatatttttcatatttaaataactatctgccgcctttgctggtccaatacatactgcatgatctgctaactgcacatgtaacgaagtactatcaacatcagaataaacagctaccgcttcaattcctaactcttgacatgttcttataattcttaccgctatttcgccacggttagcaattaaaattcgtttaaacatatctattacccttcaattaccatcaatacttgatcatattctaccaggtcttctgtttcagccatgattgcactaactgttccatcaattggtgatttgatttcattcattactttcatcgcctcaacaatacatagtacctgacccgcttttactttactaccaacttcaacatatggcttagcagttggtgagcttgcagcatagtatacacctacgatcggtgatttgattggagtccctgttattgccggttctttaaccgcttctaaaggggctgatgtcgaagaaaccggtgttgaagaaacaggaagtacagctgcttcactattaactacatttacaggtgctgctggtgctttttctaattctaatttaatatcatctatttctactttcattttgaaaacttctgagttttcaaattcattgataagttgttttactaaatcaattttcataatcttctcctttgttttgaatatcaaagtaaattttcttaaaaaaataatgctcatactttgaacatcaaaatatttttttgcaaaattattacccagtcaaactgggtaataaaattaagcgtttgctttgatataatctacgatatcttgtactgttttgatttcagctgctttttcatcaggaatttcaatatcaaattcttcttctacagccatgattaattcaactgcatctaatgaatctgcatctaaatcttcttttaaattagcttctaaagttactgcatcttcatcgcaacttaatgaatcaacgattatttcttttactttttcaaattccacgttttattcctcctcgtgtatattacgcgtacattataacaaaaagaaattatttgtaaatagtttgatgttcaaaatttttatcaaattttgtttatttactcaaaacccaataaaatcaacagtttttaaccatatttttataatttcttttttcaaaaaataattcaaaagtaaattaaaattattgttatgtccaacaataaaaacaaaacgataatacttttctaatacagtatgacgttaaaaatgaaacagatagtacaacaaacgatattttttacctattttattcaaaattaaaacataaacaggcaatatcatataatcaaacaaaatatctatcatcgtcattatcaccactgttaaaacatacttgattttataaatcagttcatttacaaaaagcatatgacaaatctcaattatatgcataaagaaaaaacattaaaattaaatatgtgcaccaataacgcttcccatacaaacaaggaacaatataaatatgtatatagtaacattcaaataaaaagaataagttactataataacttattccaaatcatattattttatctgcgcgtttatataattcattacctcacgataaataacctgcatcctattttttgtctcattatttcgataatctaaacggctatataaaatatcaatatatctattatttaaaatttctaaaaaacaatatttaaaattcaaatcgaaaacaaaagcaaaatgcgataaccagacatccagatctgtcttacgcatcgtacataaaactgtttgatgatttaaaaaagattggtaaacttcatctgtaattgtttgattctcaatttcttctttagttttatcaaaaatcggctctaatggaagagtacatttaatttctaaattatcaattttatcagcatcgcgaataatcttagcatgcatcaattctcgttcatttaaacctgattcgataacaaacttattatgattttttattgctttatatataacagtatcattattgcggtcgttgttaaatttttcaatcaatttatcctcaaataacaatttcacaccaaaatcagcatgatctacagttaaattatcataaaaactattatatattcgtaattgctcaaaacgcccaatgtcatgcaataatgcaattaaacacgctaaatcaatttctgactgttcaatatttaagctttccgcaatagctctagctttatttacaacactataagtatgttttatttttagttcaactttgggatttgttgtatcgtaatccttaacataatcattaaacactttatatgcttcttctattttaaacatcttatcacctcattattagtatacaatgaatttcttgtttaacctactttttctataaaataaataacttttaaatctatttatcttaataaaataccaatttcttcatagttatgttatatttataaatagggatgtgattagatgaaattaagactaacaaagactgacgatttaaatgctgttatggaaataattaatcaagctaaatcttattttaaaacccaaggcattaatcaatggcaagatggttatccaaatgaaatctccattattaacgatattggactaagtgaggcttatgttttagaagataatggtaaaattattgcaacagcaatgatttccaaagctatcgagcctaattataattatattgaaggaaaatggttacaaaatggcaaatatcttgtagtacatagaattgccatccgtgatgattataaaggacaaggggtagcaaaaataattctagatgaaactttaaaattatttcctaatatatcaagtattcgaatggatacacatgatgataatctttctatgcagcgttttttaactaaatatggttttaattattgtggtactatttatttagaaaataaagagaaacgccgggcttatgaaaagcttctttaacctgcaagattttgcaggttttattttcttctggttattaaaaaataatatgattaaaataaatattattcatatttacaatcatttcacatatcttaaaatgaggtgaaaaaatgaactgtaagatagatagaccttatcctaaagtagcgattgaggcaccaaatgaaacatatggattaatgattttagataatgttggcggcatgaattctaaaacttctgccattagccaatatatttataatcatactattactagtaaagaattttttgaattaaaacaaatatttttagatatttcagtggttgaaatacatcatttaaatatatttatggaattagcactaaaattagaaatggatcctcgctggtggacttgtttaaatgaccagtgttgttattggtctccttcgtatttaaactatcctcaacaaattgatgaaatattacaaacatccatcgataacgaatatcaggcaattaataaatatatgtatcaaatcaaacatattaaagacccttttattattgcgattttaaagcggatcattgatgatgaagaattgcatattaagattttaaaagaatggcaggctaaattagttagataaactaactaattagcttgccttcttttaatagttgcaacatttccaagttttgtgctgcactaccaacataattatttatcccatttaaattagctagccgccttctgttttcaaaactgatatcttcaccaatctcatttaaagcatttactaaactatcgccaacataattaggattagataaataattcacttttccttcaattacctggtcatttacccagccctgatcttcacctatcaagtatggatttcgagcattttgcacaattctgcttattcttcctacattacgatatggtcgcaatggattagttgactcacttgtcaaaaatacataattaaatctaactgtatcacctattttatattgttctacaggggtattcttatcaaaattattttttccagcttgtttaattattgtcggaaaatctttgtagcaataatttaagtcaacgatcgttggtacaccttctacccagccagttgatgaatattgccacatatcatacggcttatcgaaattcaattctgatgcatagttggcaacccagcgtgtataattatcaaaaatattacttgttaattttgttttccaccagtataaagatgcatacattccaacaaaatagccatttgcttccaattcatcagcaaaagttttggcaatatttgcaattaccgcatttgattgctttcctgtggtattttcatcttctaaatcataatacacaggataagccattttataatttttaactaatcgcattacatgctgcgcttcacctttagcatcactgctgttttttgcataagaatataaatatacaccaaaagggatacctaatcttgtacattcatcagcatttcgtttaaataatttatcatcctgaccaggaagatcctgtccataaccacatcttataattgcaaaatcaatatgtttttttgctgtttcccaatcaatcaaaccttgatattgtgaaacatcaattccgtgtgtcaatacatctcttctcaattccattatttttcctcccaattttaatatatgaagattttatgaaaatgtgtgagtttgacaacattttcatcattttggtgttaaaataaaaataatgtgatataatcacattgatatggagtcactatccatatgacttaaattgaatataaaattttataatatattaaaaaaacaggaggtaattaaatgaaaaagctattcatttcaaccttaggtgtatgtacggcactatcattattggtttttcctacaaccattaaggcaactgattttgaagggcaagaagataagtatatgaaaatttgttcttcatccaacctatcaaatagcaatttaaatacgtgcaaagaatttaatacatatcttaaaaacaaaaatcgagagttaaaaaatcaagtcaatgatgctaaaaatgaagcttctaatactaaagctaatattgatagtattacagcagaaatcacttcattaaatgataatattgctcaaaaagaagctgaaatcaattatttgcaaacatctattgctaatttagaagcaagtattgcaaaaaaagaaacagaacttaaagatcgaatgtattcaatgcaaacttatatgaacgataattcatatattgatttcatctttggggcatcagatttttctgatatgttttctagaatccaaagtattaatgaattaacatcttacgataaagaattagtatctgaattagctgatgagaaaaaacaagttgaatcacaaaaagctacagtggttagtgcaaaagccaatattgaagctcaacgcgaagctaaaaaaacactacaagagcaatttgaagcattatatattaaacaaaatgccgaagttattgctcaagaaaaagcagctttacaagctcaaaacagcagtcaaacaattgatgataatttagcggcctttgctgctgctgtaaaagaatccgaagttccaagcggtagtgtagtttctggcgattcagaacttggtaatgctattgcaaacaaggcattaagtaaacgaggaagtgtttatgtatatggggcatgtcatagtatgtccgaaattgctaatcctaatcagtcaacttttgattgttctggtttagttagctgggccttctatcaagctggtgtcaacatcggcagcaatagtactaaaacattagcaaataagggtgtatcagtatcacgtagtaatatgcaggctggagatattattttatttagtagtaatggcagcgctagtggtattcatcatgttggtatttatatcggtggcggaaatatggttcacgctccacaaactggtgacgtagtaaaaattgcttctttgagcagttcttattatcaggctcactggtatgatgttagaagattatattaagataagcaaattgcttatctttttatttattaaaaatagtcttttaacttagaaaatttataaacatctatttacttatgtcgaattttgtaggataattaccgtgtatcgaggtgattaaatgaaaattaaaaaaattataccggcaatagttgtattgtcacttttaacaactacatattctaatgtctcaccagtaaaagctgtggattttgaaggtaatgaaagtaaatatatgaatttatgttcatcttctaatatatctaacagtaataaatcgacatgtgaacaatttaataaatatttaaagaaaaaaaataaagatctaactgctcagttagcttctcaaaaagaggctgctaacgatactaaagcaacacttgaaagtgttcaaaaacaattagatgaaattaataaacaaattagtgataaagaagctgaaattaattatttaacaacaactatcgctaatcttcaagcaagtattgaaaaaaatactcaattattaaaagatcgcatgtattcaatgcaatcttatagtaatgataatacattcatcaactttatttttggggcttctaatttttctgatatgtttgctagaatcgaaggttttaatgaattaactagaagtgataaagaattgatcgctgaattaagcaatcaaaaaattcaagttgaagaacagcaaaaaacacttgaagatgctaaaacagcattattaagtcaacaggaagctcaaaaaactttacaaaataaatatacagcattattagaagaacaaaataaaaatattgcttctactcaaaacgctatctatgattatggtgaaatgacagaaagtttaaatgcagcaattgaagaattcaacaaaaatgcatatgaaactcctgctcctacaccaccaaaaccaaataattcaaacaataactcaagtaacaattcaagcaataacaacaataattcaaataacaattcaagtaataataacaataataatagcaatagtaataataacagtaacaataacagtggcaacaattcttcaaatatcagtaatttgggagaaaagatttatgctgctgcatatagtcagcttggaaaacgttattggtggggagcttctggtcctgattactatgattgctctggtttagtatattggagtttaaaacaagctggtgtttctggaggacgtggtactgcatcatcatattcacaaaaatggacaggtgtcagctttaacaattctcaaactggtgatctagtatgtttcggaagtcctgcttaccatattggaattgtaatcgttaactctgatggttcaagatcaatgattcatgcaggagggggcgacagctctacacatggtgatgatcctaatgcatatgttaagatttcttcaatagaaccaggttcatattattattctagaatttcaacaatacgacatgttaattaacactgataaactaatcagtgttttttttatttatatatttaaatatcttcaacatgtgctataatcattcaaagaatgggggttattatgaaatacatacatcaatttttaattattttaacaatttcttttattggggaactgcttggactaattttaccattgcctattcctgcaagtgtatatggtttaggaattatgttaatatgtttatttacaggtattattaagattaaacaaattgaagatgttgcagattggttaatattaatcatgccagtattatttgtaccttctgcagttagtctgatcaatgtaggagaaacaataatgaaagatattttaattattagtgtcattactttgattagtactatagttgttatggtcgttacaggaaaagttgctcaatctataattgaaagaaaggagcatcatgaaagtgaatgatattttagttgatactgtttattttggactggttatgagttttttatgttattgggtagcgatgcaaattagaaaaaagttaccctatccaatctttaatccacttttaattagtgctatttttattattagtatcttagttatttttgatattgattttgatacctataataaaggtgcacaatttattactatgttgttaacaccatcaactgtatgtctcgctattcctttatataaacagataaaaattttaattaaacattttgatgctattataatcagtcttttaagtgggtgtgtagctggtattgcatcaatatttatcttatgtttttttatgaaagttgaacctattatttattattcacttttaccaaaatcaattactactgcgattgctatcggtgtttctgataaaataggcggtaattctactattactgtaggagttgttattgttacaggtatcttaggtgctattatcgctaaaagtatctgtaaactatgtaatattaaacatcctgttgcaattggtttagcacttggaaacagcgctcatgcaatcggtacagcaaaagctcttgaatttggtgaaattgaaggtgccatgagtagtttatctattgtaatagctggattactgacggtaatcattgctccattaatggccacattactttaaatatattaccaagataaaattttaagtcactaatactcttatttagaatattagtggttttttagctaaaatataaataccattaacataaattatatatttctaattaaaaagggaagcataaatttaaaattcatgcttcctcttatttattaatctatattcaaagacctatttatgtgctcttctttttttgtttgctgctaacactactgaagctattgctaatcctgctagtgaatatcctaagcttgcactatctcctgtcttgatacttgctgttatatctcctgcttttactacagtgtttgctacaactgcttccacactattatctggtgctgctgggttgcttactaataatcctgctaacgcattttccattgcttctacagctgctgcaacttcttcttcggttgcattttcatttgctattgttgcctgggcatttaataatgcatcttctactacttgccatgctgccatgctataattagctgcatttagactttgagctctatttattaaactgtttaataagtctttacttggttttaatcttaagtctaaatatgctcttacaactgcatcatatacttcatttacttcatcctgcattgcattttcattagccaatacatcatttgcattttctaatgctgttgcaaattcattccatgtaatatctgtatataagtttgcatctaaatcacttacactatttacaaatgcctgtaatgctgttttatctcctttgatgaaatctaacatttgcattacatttgctagacgagcaaatgcattatcaacttgtgcttgactagcactgttattagctaaaacttcttgagcttctactaaagctgcattaaattcatttgctactactggtacaactttttctaattgttcattacttacattttgtgctacttctacagcaatctctaatgctgttttatcagcatctactactggattatcttcttttgtccagcatatatcttttgcaaatgtataaacacattgtccccatgtataaatatcatgtgaaccatgtactaatcctccatctacaaagttttcttctggcatagctaattcacaccagtcacgaattgtttcatatgctccataatatccaaatccattagcaaacaatgctgtatctgaatcccctgccattgtaaatactactgaatttaataaatcttctgatggttcgatattagcatatacttcttctagatatgctgctccatctctattgaatccacttgaactatatacaaatccatctttgaatgttgcatttccaatattacatcctgagaaaattccaaaatatccaaaactatcagcatgatggaatgccatatatgttgttgtcattgctcccattgagaatcctgcaaaagcacgatcatttggatttgttgacacgttataatttgcttccatatatggaattatataattaattacattatctgcaatacgtccataattccatccgaataatgtattgtccataccaacaacgattgcttcttgatctggattttctgcaattaaatgatccattgcatttgttgcttgtggttgtgagaaccagtatgtttcatttccaccagctccatgtgataaataaattacacgatatggttcagctctatcaggatcatagtttgctggtaaataaattcctaaatcctgatcatctgccaataatccttcatattctacatattctaaagttcctttattatcaccttcatatggtgtaaggtaatctaaatttggtgattctgattgttttacaggatcccattttccataaactatactatgagtaatatcacctgtatctgaattactgttagcttcgttttcacgacatggtgataaattaaatggatcgtcaatcgttacacttcttcgattatcaaaactaatttgatagtaataataatgagccccactgatcattggaatatccaattcataattaccagtttcctcatttaatgtcatatcaaatgtccattcagctccccatataccacttcctgtatcacgtgtacgtgggtgaacattggcacagaaatcaccattttgatatgcatctaaaccatgatctgaattttcagacattggtgcatcaccagataataatctaaatgatccaacaacttgaacaccagtaattgttgtaccttctggaacactaattctagaatcgttatttacatcataaacaaaatgtgctgtatatcctgatgatgattcttcatcttctacaacagtaactcctggttgatacacttcttcaggtgtatcaatttcaccaggatttgctggcttatcttcatcttcccataaaaagtcttttacaaatttagagaatagattacgccatacaccccagtcatgagcaccgttgatttcaaaatactcataatctgcacctgcagcctcaaggcttgcaataaatcttggatatgttgatcttccaaaatcaaaatgtccatatcctaacattaatgttggataatcaaaattttctacatttggtacatctacagttacattatatgaccaaataccaaaatatccaaattcaccagctaacgttgaatatactgatgatgctgtcatcccacctgctgataatcctgcaaaagcacgatctcttgcatcatgtgaaacgctataattttcttccatatatggaataatattttccattaagttttgtttaattcttgtataattccatccaaaatatgaattgtccattgttactacaattgtatttggatctacttcacctgcggcaattaagttatccatgatgttgtctgctgcaccaatttcgtgccattcaacttcatttccaccaccatgagataaatataatgttttatatgtttttgatgaatcatatccatatggtaaataaattcctaatggctgttgtgtacctgtagatgctgtataatttacataagtagtttcccctacttgcccatcagttcttgggaaaatccattcttgcccatctaaagcttcatcactatttcctacaaataataaactccatccactatcactaccatcattatctaatggcatatttgttggatctttaactctagtagttgttgttccatcattaatatcaaatgaatagaaccattctccagctggtacaggaataactactgaccaagttccgttatactcttcagtcattgcataagcaatactttgaccagaagtcatgacatcatatccagttggaaacataccatctttatattgatatgcattgtaagctacaattctctcaccgttttgatattgtgagacttgttcttgagaataaaattggaatccaccaactaagttaacactttctaaatcttgatcagttttatatgtaaatctaacttgatattgtgcatcagattcaggaaaacttacatttctagaaattgtatatcctggttgagattcgttttcaactgcaaatacataacttacagttgaaaataccattgctaatgaagcaatgattgataataattttttcataattccctccatttccgtccgccttcgtcggtcagacacaaacattttattaaaaataattctcatccaatcgtttttgtagtatcctataagagaggtggtatactacagagcacgtggaggagagtaggcaattctactctatatagaatatcctgaataattataagtcgccgtcagtctttcaagcacaaacaagtaggacttagagcctggacacttaagattgtttttatcaactatagtgatattttgcagactgacagtcaatgccacttctccttttttgaaaggagtttttttatgcttaaaatccaccgttttaattgtgctggtcttgatgttcacaagaaccttatcgtcgctaccattggtatcactgacaagaaaactcatgtcactgaatatattcagaaagatttctcttctcttaactttgacctctataatcttaaaaactggcttattgaacacgaatgttttgatgtctgcatggaatccactggtaagtattggttccctgtctttaatgtccttgagactgaagctaaaatgaatattgttcttgtccatcctaaatatgtcaaagctatcaagggcaagaaaacagacaagaaagattccaaatggatttgtgatcttttcaagcatgatcttctcaaatcttcttttatcccgcctaaggatattcgtgaattaagggatctctctcgttatcgttttaagctcatctgtatgagaactagtgaacgtaaccgttatcagaactccatgactgtttccaatattggtttggcttctgttgtttctgatacttttggaaaaacagcccaggccgtcatgaatgaagttctatctactgaagttattgatgaagataaaatcacaaaacttattcatggtaagtgcaaaaacaaagataaaatagttgaatctcttaaaagttcaaaaattgagccagatcaaagatttaaaatggcagaaattcaatcacatatgaatgaacttaatcaacatattgaagctgttgaagtagaaatcatcaaacgtgcttccagatactttgatgattttttacatattacagaaatagatggaatacagcttatgtctgccattcttatcatttctgaaattggcgttgatatgactcaatttgaaacagataagcaactatgctgctgggctggactttctcctgccaataatgaaagtgcaggaaagaagaaatcagttcgtatcaacaaagctggacaatatcttaaaccagtattagtacaatgtgcattggcagctatcaaaaacaaaaacagttattttggtcaaaaatatacaaaaatcaagaaaagaagaggacacaagaaagcaatcatagctattgcaaggatgatgcttgtcagtatttatcatatgattcttactggagaaaagttcaatccttcagactatgaatcatttaagaatccaaagccacaaaaagaaaagaacaattatacagttgagacagcacttgattttctaaaatcacagggatttgatgtatcaacaattcaagatattcctaaataatattctgttttttctaaataaaactgaacttgtttttaagttcgtctttttttgtgtttttactcacgattgggttcaattatttttcacactttctcctttcttttaataactatctttctctctctttaaattttgtcctttactcttcctcctttacccaaagtatagcgcttacaaataaagcttttcaatataaaaagaattcattatgttttataaacaaaaataagctatttttaaagctatagttgctaatacaacttcttttttgttttttttacaaatttttatcttcataaattgtttattttttaaatttaattttatctaaaccattcttataattttatataatcatataataatgctacaaacagctatcatcttatttaacattttaatataaaattatgctatttatacatgacacataaataagtaagtatacttttttataaaaaaacaccttttgttttggtgtccatcacatttttagcgtcatatcaagtctcattcatcgtggtaaaataaatgaattttgtaatttcaaattttttgaaaatataacattcatacaaacaatctcaaatcacatataaaacttatattaaataacgaaaaagactagtcaatgactagtctttgcattaagtttcaattaattattttgttaattcagcaaaatatttgattgttctaaccatgttagaagtatatgaattttcattatcataccatgcaacagtttgaacttcagtagttccattatctaatggtttaaccatagtttgagttgcatcaaataatgatccgtaagtaattccgataatatcagaagatactaattgttcttcagtgtatccaaatgatggagttgttgctgctttcatagctgcatttacttcatcaactgtaacttcaccttcaacaactgaagttaagattgtagttgatccagtaggaactggtacacgttgagctgaaccaattaattttccatttaattctgggattactaatccaatagcttttgctgcaccagttgagttaggtacaatatttactgcagctgcacgagctcttcttaaatcaccttttctatgaggtccatctaataccatttgatctccagtataagcatgtactgttaacatgataccagatttgattggtgctaatttatttaaagcattagccataggtgctaaacagttagttgtacaagaagctgcagagataatagtatcatcagcagttaaaacaccttcgtttacaccaaatacaactgttggtaagtcatttcctgctggtgcagagataacaacttttttagctcctgcatcaatatgagcttgagatttagctttagaagtatagaaaccagtacattctaatactacgtctactcctaattcaccccaaggtaattttgaagcatctgcttctgcataaattttaatttctttaccgtctacagtaatagatccttcaccagctgaaactgtatcagctaatgcatatttaccttgtgctgaatcatattttaataaatgtgctaacatttttggatcagttaaatcgttgattgctacaacttcatatccttcagcaccaaacatttgtctgaatgcaagacgtccaatacgtccaaatccattaattgctacttttactgccattctttatattcctccttgaatgttctttatgaacatattatattccagaaattaaagaaaagcaactaatgaaatgggtttcattaaaaaaaataattaaaaattaaattttgtcttaattaaaatcaaaaatataactgatttcatttcgattaaataaaagataaaatgaataattattatttaaatcactatacttaaatatggaggtaagataatgcatttaattcctactgtaatcgaaaaaacaaatcaacgtgaatatgcttatgatatttattcacgacttttagaagatcgaattattttattaactggtaccattgatgataaaatggctagcagtattgttggtcaattattatatttagaatccattgataacagtgctgatatttttatgtacattaactcacctggaggtagtattaacgcgggaatggctatttatgataccatgaattttattaaatgcgatgtttctactattgtcattggaatggctgcaagcatggctgcttttttacttagttccggttctaaaggaaaacgctgcagccttcctaatagtgaaatcatgatccatcagcccttaggagcttttgagggacaggcgagcgatattgaaattaatgccaagcgtattttaaaacaaaaagaaaagttaaataaaatcttaagccaaaatacaaatcaaccattaaataaaataattatagatactgatcgtgactattttttagaaccagatgaagcattaaaatatggtttaattgatgagataatataaaagacatcaaatttgatgtcttttatattatctttgtatttctacactgatatgccaataaacaagataaccaaaaaataccgcctggtaaccaaaaaataataaaatgataccatcttagttttattcctttaaaccgacttaacatatcatatttcccttctataacttatctgtataataaaattttataaaaactttgtcaatgtatttttttactcataaagacaacatcatcctgtatcacgaacccatttttttgataaaaatcaacactataaaaaccttttcctgtcaataacataaaactatcaacttcatttatttctttttcaagtaaagttaacattttaccaccaatccccatcctttgataatctagatcaacataaaaatcttcaatcattaacactacatcttcaacataagtaactatttttccacacataacccctactattttattatttatcaaataaacatagcatcttgtatatttaccatcatctaattgttttactctttgaagtgcttgataataatcccactcttcgttccagggaaaagctctaaatgttttaattagtaatttagcgattgcttcataatcatctacagttacttttctgatcatttctctttacctataaaaaagcaaaacctaagtcttgcttaattataatcatcttcaattgttgaatctacatcttcttctggttcttcagatacatcttcttcatcatcagcatagatatcattcatatcgatatgaacatcactaaatttatgacgacttcttaaatcccaattattttcacctacagtgataaagcgaccatctaaagtaatattagtatagaataatgattctttatcatctttttctatttcatcaaatttcttcatttgacaaacttcttcccataatttatagaaattaactgccgatctctttttagacattaattcatatgcaacatcaaccatagacatattataatatttattcatgctatccattttaacgatcctcctacattttttctggagcacttaccccaattaaattcaaagcattagccattgtaattcttgtagcctccactaatgccaatctttgtccacttaattcaagattattttcatcaataacatagcattcattataaaaactatgaaataattgtgctaatctttgaatataattagcaattttgtgtggtgctcgatttatcgctccatcaataattacgtttttaaattcattaatatgtttaactaattcaatttctttatcattaactaataaatcaaatttgtcgctataaacaatattagttttagccgcctgtactttaattgaacacattctagcatgcgcatattgagcatagtacaccggattttcatttgattttgatttagctaaagcaatatcaaaatcaaatggcgtattagctgctttagagacaaagaaatagcgtgttgcatcaactccgatttcttcaattaagtcttttatcgttacagcattaccagttctttttgacattttaactggttctccatcattcatcattctcaccatttgaataatatcaatgtttaattgatcagcattatatccaagagcctggatcgcagccttcattcgattaatatatccatgatgatcagctcctaataaatcaactaaatattcatagccacggtctaatttatttaaatgatatgcaatatcaggggttaaataagtatatgatccatctcttttaattaaaacccgatctttatcatcaccaaattcagttgatttaaaccataaagcgccatcttcttcataagtatatccagcttgttttaatttctcgattgttggtacaactttattttcttcatacaaagaagtttctgaaaaccatacatcaaacgaaactctaaactcatttaaaatatctttgattttttgtaattcatactcagttcctttagctctaaaaaatgaaattgcctcatcttctggtaaatttaaatacttatcaccatcaacttctttcattttatttgcaatatcaattatatcttttccatgataaccatcttctggcattatcgcatcttgattaaaagcttgtttataacgtgcatataaagataatgctaaattatgaatttgatttccagcatcatttatataatattcacgtgttacatcataaccagccgcactcatgattcgacaaatactatcacctactgcagcacctttagcatgacctaagtgtaaatcaccagttggatttgctgaaacaaattcaacattatattttattccattaccataattgcttttaccatagttatctttttcttctaatacttctttaatgacagacgtcattgcatctttagctaaaaataaatttataaaccctggtcctgcgatctctattttttcaatattggctgtttctctatctaatgactctactattgcattagcaatttcacgtggatttctttttaataactttgttaactgcatcgctaaatttgttgaataatcgccatgtgctttatctttaggaatctcaattataatattttcctgatcatattcttctacaaatccacatgctattatcgcatttttcaacgcactttttaaagtcgtttctatcttattgattgccattattgtcctccttacgtttttaccacatatcttaattaaattaccattaaacccgcatgaagtcaatgtttttaaaacaatttatctaaatactttatctattaaaatctataaaataaaagctttacaatagtggtgcaaataatctcaatatcgcctctaaccagcctctaaagcgcccccgtttaacatcagctatagtcatttcttttcctagtgctattgtttttaaaaaatcctgcttgatatcattaataactgaagcattataaatataaactccacattcgaaatgtaaatacagactacgataatccaaatttattgttcctaccgttgccactttatcatcacaaacaaaatttttagcatgaatgaatcccggcgtatattcatagattttgacaccttcattgaccagtggctcataataagaacgagttactttaaatactagctttttatctggcactccaggtgttactatccttacatcaacaccacgttgtactgctaaacaaagagcgtttttcaactcatcattaataattaaatatggtgtatcaatatatatatatttttgtgcttgatttatcatattcaaatagacattttttcctactggtttattatcaagcggtgaatctccatatggtaaaacaaaacctgttgcttttactgattcaagtggataatgacgaggatgatatttatcataatcctcatatgtatttaaagaagcattccaggtcgttaaaaacatcaaggttagattccataccgcttcaccacgaatcattacccccgtatctttccaatgcccatatttaacacgaacattgatatattcatcagctaaattaaatccgccactaaagccaacatttccatcgataacggtaatcttgcgatgatcacgggtattcatcacggccgaaataaagggtacaaaatgattaaaagcaatacattttattccatagctttctaattgttgataatatttaaacggcagcatcgtcaaagaacccacatcatcgtacataaaacgtacttcaacaccttctttaactttttgcttcaaaatatttaaaaccgtattaaacatttttccttcttcaacaataaaatattccataaaaataaaatgttttgctttgcttaattcttctaataaatccgggtaagcatcatcacctagtgaataatatttaatttcactattattataaatgggaaatttttcatttactaaataattcacttgtcctttaacaataggatcatctattttatcttttacatcattaaaataaatataaggtttaatagcttcattttgattattaaaagcttcctgtaatccctttgttggttttttatttccaaacacaatatacaacaaaccaccaaaaaccggaaaagataagatcggtatcagccaaataatcttatatcctggatcatcattatcattgttaataatatataacgtcacaaatacacttaaaatcgtaaataaccagcgtaatgtccttgaatcaataaaaagaaaatgtacaaacagtgccacccatatcatttgaattacaattaaaataaatgatataactatgcgattagataaaaactttaataatttcattttaattctccaatactgaataagatatcatcatataaacttgactaactaaatttaatccctcatacaattcatactttatcttaatagtgttacccgtctcataatgaataagccttgtctttaaagaaattactccgtaatctgtttgataatcatttaaaacatcttcatttaaaacaaggtgtaaaatacctttaccattatgtaaaactatttcatttgttttgatttctactttaatttgtctatcttttacaaaactaatagctttataaccattaaattcttctaaataaccattttcatcaaatttaataacttcttgatgatcttcatatttaaaaatatttcgatatttgatcttaattaactttttcattatatcaccgtgcatattataacacaaattcgtcaagaatacttttggtgagataatgaaaaaattaataaaaatactaataactattttagcaagtcttacaggtattcttttatccttatatattattgcttattcaatgggagaacctgatttaaataaaaatcgttatttaaaattatatgatattgatcaagaaatttattatcagtcaattaatgattatgctggtcattatgtcacgttagataacgtgagcagttattttaaagatagtatcgttgctattgaagatcaacgtttttataaacatcgcggctttgatcccattggtattatgcgggctattaaagttaatcttacaaatcaaaaaaaatctcaaggagctagtaccatcacccagcagtatgctcgtttactgtacttaactaatgaaaaatcatggtccagaaaattgaaagaagctttcttaacaatgcagttagaaactcatttaagtaaagatgaaatattagaaggatatgtaaataatgtatatttcggtcatggtatttatggaattgaaaatgctgctcaatacttttatggtaaaagcgccaaagatctagatctaaacgaaagtagtatgttggcgggggtcgttaacggtcctacttactattcgcctctcaatgatcaagaagccgctcgtaaaagacaagcaattgttttagatgctttgattgattgtcataaaataactaatgaacaaaaagaaaaagtgttaaaaagtgatcttaacttagcctctgaacacaaagtagatgaaaatctcgctaacaatttttataaagacacagttattgatgaacttgaagaactaggttattacaacaatacctatttaaatcagggattaaatgtctatactacttttaatcaagattatcaaaatatacttgaaaaaagtgctaaagattatactaaagatagtgaggttgaaacatctagtattgttgtagaaccttatacaagtaaaattctagctttgattggcggaaaagattattcaagctcacaatttaatcgcgccactaaatctaatcgacaaatcggcagcactgtaaaacctttgttatactatcttgcactagaaaatggttttaccccagcaactacatttctagatgaaccaacgacttttaaactcgaagataatagtacttatagtcctagtaattataatgataagtatgcatacaaagacattactttagctcaagctctagctgtatctgataatatttttgcagttaagactcacttatttctaggtaccgaaaatcttgcaacattaattaaaaaatttggtattgaaaatgttaaaactaatgcttccctagctttaggtactgttaatacgaacatttataatctagctaacatgtataatgccattgccagtgaaggaatttataatcatctttatacaatagaaaaaataactaataataatggtgatgttctttaccagcataaatccaaaaatgaaaagatgttgaatcaagatagctgtttagttttatcgcagcttttgaccggaagctttaacagtgtatttagtacttatttacaagcgacaatggcagcctatcagctagataatattaatgcctgtaaaacaggcagcactgattttgataatcttgcagttgcatataatcctaacattctagtcgccagctgggtgggatatgatgataatcgcaaaatggagactacaaacgataaaacggttgctaaaaagacagtcgttgatgttttgaattatactaatgaaactaaagaagctacctggtaccagccttctaaaaatatccaagaaattgctattaatcccttaactggggattttgatgaaaatggtgttgtttactggtttaaaaaaacgtaatcctgaatcttatgattcaggataaaatattttatgatctattttattctttttagaattaattattgctccaacaatttctgatacttctggtaaagctttagtttgatgatttattaagatctcaattgcttctgtttcatcattatcataatacaaatatggaatctggctttggtcatcgctaacaacatagtagcggggatcatagccttttttggcatatcgatccctcatctttaacttttcatcactattatttaaatcacgatatataaacaattttcgatttaaaaaacgattacataaatctgccaatattttatcttttccttcactcaaaaatctaaaataatataatacgatattttcatctaaatttatataatcaactacatttacttttccttttaaaaaaggctctaaataacgaatctctccaaaatcatatccatcaagataaagatctttcattcttctaaatatactaatcaacaattgttcataacttcttgaagttggatgataataaacctgccaatacatatgatacctagctaaaatatagttttcaatcgcctgaacaccagaagctttataaacaattttattattaaacactttcatgacccttaaaatccgatataaatcaaaatgtccataagtagttcccgtaaaatatgaatctctaagtaaataatccattctatcagcatctaattgactagaaatcatttgaatcaaaatcttatttggatgcgtttttgctatcacactgctcacctttttagaaaatcctggttcaaaattttctaaaatatgatgtacttcactatcattattgataatcttaatcgtatattcttcatgattaaatccgaaagcctcttcaaaacagtgtgaaaatggcccatgaccaagatcatgcaataaagcagcacacataactgtcaatttatcataatcatttatataatcacctatttcactattaaaaatcattttacgcacgataaaataaacacctaatgaatgacaaaatctcgagtgttccgcactttgatatacttgatgcgtaccccctaattgttttattcttcgtaaccgctgcatttccttagaattaatcaattctaataaaaccggctggtctacatgaatataattatgaactgcatctctaaacactttactatcattcaattttgtataacttaatttataagcactggaattcatttttacacctcctataaacattattttatttattattataatacagataactagtttatgctataagattcatcttagattcaaccagatcaattagtataacgataaaaagtatggtttaaagataataaccatactttcttatttctttatagacttaaaatattatttattccactataatttataaacttactaacagatttttactaaaacaatatttatcgatcttttaaatatctgtttttcaataagattcgtaagatttgaagctgcattgcaatacccaatattgaaaaactccaattaatatgggttataggatcaaaatttttccaaaaacataaaaacatccgattgataataaattatgaaaataaatgtttattagatttttagtactcaaacgaacttctttcgtcatatttgcctccatcatcttattttttatgcctgtttttcaataagatccataaaatttgaaattgcattgcaatacccaatcccatataataccaattaatatttttcgtggagtctatcctttttccagataaataaaaaaacgctagcgataacaaattaacaaaaaaaatatataacaaagtcttgctactcaaatgaacttctttcataatatttcctttctctacacactcgctctagcgtttgtccagtaagatcccgttgacccagtataatcagaattcttataaactgtaatatgatctcttaaatatctgtatgaatcatcatgataagtatctattttaaaatacacttctttttgattatttcctcctactgcagaaacaattagcgaaattaccgaagatgttactcctaaatacggaatatagcctataatattagtaacaatttctcgcccttgtttatcataagtacttgaacattttatagtgtatgcataataccatggtccattcatcccaaatggttgaatttcttctacatatttttctatttttgcaacttttatttcgttatcaaaatataaatagttatcttttagatcaatagaatgaaattctccattagataaactaataaaacaagcaaattccccagtctgaactatttttgtgacttcatttgcgattaaattagtaataatggtctcattatcatgtttttctattttatataatacatcattagattcaatatattcgattgctccatcgatgttctcgcacgctgaaacatctaaaataaaacatgaaaataataatacccatgctaagataaaacatattgctttttttatgttattataaattatttccatccaaaattctccccttttatatatctggttatataaattcaaacataaatacgtacaatttcattatctattttttacataaataaatgaaataagcttctatatatacataacagttttattaattattttatcccattatgattctaatatttagtattttggaataaaataataaatttagactataaagatttcctcaatactataaactgtgtagtcaagagtatctcatcttgacttacacaattcatattacaaattttaaaaattatttctttctttttttgtttgctgctaataccattgaagttaatactaatcctgctaacgaataacctaaacttgttgtatctccagtcttgatacttacaattgtatctcctgattttactgtcttgcttgttacattttcatttactacaggtacttttgaatcaactgctagtccttcaattgcactattcaatgctgttacagctgcttctacttctgcttctgtagcttctggatcatctaatactgcttggacatcatttaatgtttcttgtaatacattccatgattcagcactgtaacttgccgcatttaaaccttgagtcttattaattaaatcattcaataaatctttatttggttttagtctcaagttcaagaaggcttttactaattctgtataggcttcatctacttcatcctgcattgcattaacatcaaccaatacatcatttgctttttccaatacagctaacatatcagaccatgatgattcgatgtatttgctttcatctaagtcattgatttgatttacttgtttttgtaatgctgttttgtcaccttgatagaattccaacatctgcattgcacttgctagtcgagtaaaagcactatctacttcactttgagtggcattagtttttgcatatacttctcttgcgtttgctaaagcttcgttgaattcagttactacaactggtacgacattttccaaatttgctttttcagccatttcaatagcaattgataatgctgttttattagcttctatcataattgatgttttagcaataccgttagtaaattgtagcattacattatgttttccttcatctaatgtttttaaatattcagcattaagaataatactcattgcatcttcagcaactacataattatctttgctaactacaacattatcaactaataatgttgtaaaattatttttttcaccattacttgttatattgattccattagagcttccctttatccaagtaccatcttgaccctcaattatatcatatgcagtcgttaaattatttctaaaagtaattgagcatacattaagtacctctcgatcagttaaaccttcactctgtaattgggctgccctttgagccgatactacttcaccattttctacaattactaaacctccactccatgatgaatcagcttgaatttgatcataagcatattgtatcgctgtagcaacccatgttgcatactcaggattatttaaatatggtgtatgtccgccaatattatatcttatttcattttcaacaatgtaattagctgctttttgagctcctaataaccaattttgagcatttgacatataaaaattagttcccccatactggatttgagcgcctaaagaatcaccactataaattactttatgagttagatccgctaactgtccgcctcctggagtatgttcattaggaatttcaataaattggaactcaaccccagctactgtaaatttctccatatctgacaatgttttaataggaaatgctgcaacaacatcaattccattaagtgtcgcatgtggttcattttctggccaatacattgttgtaatttcttttaatctttcatcctgagcaataatagcaagattatcacaatgatcaagatgattatgagtacagaatatctttaatgattcacatttatcaccaataacactttttataaccctatttaatacattttgtccataaaaatcaacatcaatcataaatgcttcttttccatctttacttacataaatcatcggattttctaaatctgtatttctaagcatataccatgttccagcatcatcttccttcattttaataacaaagaaattaccatactgtgtcgttaaatcatgttgattttggtatgcataatcagcatcatatcccataactacacctgtgatggaatcatgcattcctatatcgtatccccaccatccatgagcatctatatgaaattttaaagttacatttctttctttactggtagctataacatctgttccacctcgatatgtttcagtagcaaacgcttctgtatcataagcagaatcccaatcatattgtaaatctgtagttggatcaaaatcattaatttgttttaacaaaccgactaattcattgacatatgtggcatcaaccatgttacctttactatcaataattgtataaccttcatttttatcaactaattcttttacttgtaacacatttgcataatagcttaacatattataataacttgttcctggttcgccaacacaatttttatattctgatactagattaacacctactaattgtacatctacagttattgtattattttcggcatcttttattttatttatatctttgactgatagatgtgattttaatgtagttgatatgtgctgttgtgttttagtcccatcagcttcatatcttggaataataatactatttaatgctctttcactactacctgtttcttcttgaagttttttaattgcagcaatacttcttacatatattccaggataatatccatcattatttaaatcagcatctaatgaataaattgcagcataatcactatttcctccagccggaataaaatcggcattgatttcataattccctccatttccgtccgccttcgtcggtcagacacaaacattttattaaaaataattctcatccaatcgtttttgtagtatcctataagagaggtggtatactacagagcacgtggaggagagtaggcaattctactctatatagaatatcctgaataattataagtcgccgtcagtctttcaagcacaaacaagtaggacttagagcctggacacttaagattgtttttatcaactatagtgatattttgcagactgacagtcaatgccacttctccttttttgaaaggagtttttttatgcttaaaatccaccgttttaattgtgctggtcttgatgttcacaagaaccttatcgtcgctaccattggtatcactgacaagaaaactcatgtcactgaatatattcagaaagatttctcttctcttaactttgacctctataatcttaaaaactggcttattgaacacgaatgttttgatgtctgcatggaatccactggtaagtattggttccctgtctttaatgtccttgagactgaagctaaaatgaatattgttcttgtccatcctaaatatgtcaaagctatcaagggcaagaaaacagacaagaaagattccaaatggatttgtgatcttttcaagcatgatcttctcaaatcttcttttatcccgcctaaggatattcgtgaattaagggatctctctcgttatcgttttaagctcatctgtatgagaactagtgaacgtaaccgttatcagaactccatgactgtttccaatattggtttggcttctgttgtttctgatacttttggaaaaacagcccaggccgtcatgaatgaagttctatctactgaagttattgatgaagataaaatcacaaaacttattcatggtaagtgcaaaaacaaagataaaatagttgaatctcttaaaagttcaaaaattgagccagatcaaagatttaaaatggcagaaattcaatcacatatgaatgaacttaatcaacatattgaagctgttgaagtagaaatcatcaaacgtgcttccagatactttgatgattttttacatattacagaaatagatggaatacagcttatgtctgccattcttatcatttctgaaattggcgttgatatgactcaatttgaaacagataagcaactatgctgctgggctggactttctcctgccaataatgaaagtgcaggaaagaagaaatcagttcgtatcaacaaagctggacaatatcttaaaccagtattagtacaatgtgcattggcagctatcaaaaacaaaaacagttattttggtcaaaaatatacaaaaatcaagaaaagaagaggacacaagaaagcaatcatagctattgcaaggatgatgcttgtcagtatttatcatatgattcttactggagaaaagttcaatccttcagactatgaatcatttaagaatccaaagccacaaaaagaaaagaacaattatacagttgagacagcacttgattttctaaaatcacagggatttgatgtatcaacaattcaagatattcctaaataatattctgttttttctaaataaaactgaacttgtttttaagttcgtctttttttgtgtttttactcacgattgggttcaattatttttcacacttacctctatttctatatatttgtctttattaaccataaatacataatttaaatttctataaaacccgttatgatttttaaccttgttgataaatttattgtttatgatttttttaatctatatttttcgtacttaaaactaattttgatagacctttttaatattcttaataaatttttttacatcttttgaaggttcaagagaatacataattccaaaaggaatagtataatcccaatttactgggataacctttaacaaaggatggatattacgccaatttcctatcgccataagtaaattaccactgctttcacaataattaaatatatcgatatcataaaattgaaaatcaataatatttattcttgaatgatatttcaaaagatcgtctcgtaaacaatcgatataactattccagccctgacgaattaacatcaaattttccccatataaatctttaatatcaattatatctttttgagccaaaggatgatacattggtacagcaacacaaattgattccttagttagttctaaagcgttgcaatgattttcctttaaaaaattattgtcatagatattggcgactatatcaatattctttccaagattatttagtatctctctagcattttcagcagtattttcaaatgaaataagttcaaactttatttctggacaatattgttgtacagaattccatactcttaaaagaaattgacatggtgtcattatcgaagttcccaatcttattgcatgactgttttttttctcgacactctttgctcttgcaatagaatcctttacgtattgaactagataagtcacatcattataaaatgactttccagcatctgttaaagttattcctttattgtctctataaaatagtggaaaaccaatttcattttcaagcagattaatttgttttattactgctgtaggtgaaatgaataacttttgcgatgcttttgaaaaactacttgaatctgccacaattaaaaatgtttcaagatgtggattatacataaatttatcacctcatttaaaaatcaattatattaaatacttttattttctttttttatttgcaactaataccattgaagctactgctaatcctgctagtgaatatcctaaacctgcactatctcctgtcttgatacttgctgttgtatctcctgcttttactactgtgtttgctacacctgcttctacactattttctggatttgttactaataatcctgctaacgcattttccattgcttctatggctgctgcaacttcttcttcggttgcattttcatttgctattgttgcctgggcatttaataatgcatcttctactacttgccatgctgccatgctataattagctacatttagactttgagctctatttattaaactgtttaataagtctttgcttggttttaatcttaagtctaaatatgctcttacaactgcatcatatacttcatttacttcatcctgcattgcattttcatcagccaatacatcatttgcattttctaatgctgttgcaaattcattccatgtaatatctgtatataagtttgcatctaaatcacttacactatttacaaatgcctgtaatgctgttttatctcctttgatgaaatctaacatttgcattacattagctaaacgagcaaatgcattatcaacttgtgcttgactagcactgttattagctaaaacttcttgagcttctactaaagctgcattaaattcatttgctactactggtacaactttttctaattgttcatcacttacattatttgctacttctacagcaatctctaatgctgttttatcaacatcaacggttagatctggaagataaatactttcaccagtttcaacatttcgtttaaaattattaaagaaatcccatattattgaagcatatccagtatagtgattatgatttaatccttctacaatcatatatttaaaatttggaatactttcatcatcttcaaaggttgcaatatgtcctacaatatcatgcttagttgtaaatgtttcagttatataattacttatatcaaatcctaaaaatgggtaagtcatataatctaaatcattcatattcacagaaaaatctatatgatttatttttgaaattggattaatataaccttcaataatattactgtaaatatattttccatcatgattattctcacctataggatcactcccccataatggataagtaattaatacatcatttgttccatgagcaataaagaagggcagcttattttcaaaaactgttagatctacattttgataacctggtgttgctgcaattggggcaacagcggcaaaaagttctggatattcagttgctaaataatttgtatagcaaccgccattagatatccccgtagaataaatacgagataaatcgactggataatttgcgcaaacataatctataattgctttataattttcaacattttcataatcactgccattaggtgaaacaacaattactcgttccttgctagctaattctacccatccctgacattctgcctcaaatacaggatgatcattgccaccatgaatacaaaataccaatggaaatttttcttcagtttgatttaatgcttctgtaggttgccacatataataaccgatatacccatcaggttgttcatatttaaaatctaatcctgattcttcataatcaactctatccattaatgtaaaaacttcttttgattgagcatcaatccaaattacatcatgcatagcatttcttgtgatttttcgtaacatattatgccatgcttcaaaaataatatctttatttaatgaattcacatttctatcatcaataactacttttttagtatctaaaacagaattatagaaacattgttttccattaagtactgtttgctcatttgtgccattaattgttttataaaaatttatgatattactattagctccaactaaatatgctggtaaaggtatctcgcttgttgtattactattaatatttcctccaaaagtcaatataccggcaattcggttagcattttgtgacaaggtattatgaataaaagttgctccatttccttcaccaagcgcataaatcaaattacaatatgtaaaatatcctaatgaattattcgaatctgttaaaacagttaatgtatcccaataaacatttgcatcttcttctgaccaattttttccattggcaggtgtcattaataaaacacctgctttttctttttcagctaaatcaataagtcctgcactttcaagttttaaatatgcttcattttcatcttcacatatatcatcactataaacaaaaaacacaggtgtcatcattggtgcaggttcattcacaacagaggcggtatatgaataaacaggtacatttccaatatttaatgtttgaaaaagccccttcatctctgctgcatgtacataattaataaaattactgccaatcgatacataaataactacaaaagagagtagtatcatttttaattttttcattttttttacctttttcattttattttctattattaaataaaagttatttttaattatttctttttttatttgcaattagcaatattgaagcaagtgttaatcctgctactgaatatcctaagcttgcactatctccagtcttgatacttgctgttatatctcctggttttactgctgtgtttgttacaccttcgtttactgatgcacttgatacttcagcttctactaattcttcaattgcactatttaatgctgttacagctgcctctacttctacttctgttgcattagtatttgccattgtcgcattggcattttctaatgctaagcttactgctgcccatgattctggactatagtttgctacatttaaactatttgctttattaattagatcatttaataaatctttgtttggttttaatcttaagtctaagaacgcttttactaactctgtaaatacttcattaacttcatcttgcattgcattaacatctgctaatacatcatttgctttttctaatactggcaacatatcagaccatgatgattcaatgtatttactttcatctaaaccattgatttgatctacttgtttttgtaatgctgttttgtcaccttgatagaactccaacatttgcattgcacttgctagtcgagcaaagacattatctacttcactttgagtggcattagtttttgcatatacttcttttgcgtttgctaaagcttcattgaattcagttactacaactggtacgacattttctaaatcagctttttctgccatttcaatagcgattgataatgatgatttatccactataggatttgcaggtttatttgtatcttcccataaataatcttttataaaaatagataataaagtacgccatgcaccccaatcatgtccaccattaactggatacaaatcgtattgaacgtcagctgcttctaatctactaataaaattagggtaatattgtttaccaaatggatcaagatttccatatcctaacattaatgttggatagtttttattttctatattttgaacatcaacatttgctattgtgtgtgaaaacattccaaaatatccaaagtcgccagcattttcttgatataggaaagttgcaagtcgtgatccgcctgataatcctgcaaaagcacgatctccagcatttttagatacactataatgtgattcaacataaggaataacataattcatgatattatcttttattctctcaaatcctcttcctggagctgaatttcctaaattaaaatatgtaagatctaatgtaattattatcgtatcttcaacttcaccttcagcaatcaagttgtccataatatttttagcagatccaatttctaaccactctacttcatttccaccacttccatgtgataaatacaaagttttatatattttattttcatcatatcctttaggtaaatatacacccatgggctgcatcgttgcatctattgcttcatatgatacataattaaccgtccctgtattatcatcatttctaggaaaaatatactcctgaccgtctaaacaatcagtagcatcaccaacatagaaaagactccagccactatcattattaccattagcaaacggcttattttcaggatctacaatttgctgagctctactagatccagtataaaatatattaaatctgtaatagtattgtccattcggtaaagggatctcaattgtccacactcctttttcaacttcattcatatcaagtgttacataaccacctggagcaattaaatgacctgttgtgaacataccatttttaaaattttctggagctattggtgtgattgtccctacacttccattatccaaatactctttagcagcttctgttgtataaaatgcaaaacctcctgtcaattgtactcgacttatatcttcttcactgttaaatgtgaatttaacttgatactgagcatctgaattaggaaaatctgtgttttttgtaattgagatactttttggtgtttctatactttctgactcttcatacgcatttattgtctttaaagtagaatctgataatgcagatgctggtactgaaattattgaatacactgttaacatactcagaaatactgctactatttttttaaatttataattcttcattcttcctttctcctttaatattaaatttttaatgtttatttttctcctttctttaatttaattatatcgcttacatttatttatcctcaatcaataaaaaaagattaatgttttaagaaatgataaaatcatttcttaatccattaatctaatataaagatacttttttatgatttttataaatatttctatttattatatacgtatttcataaaatattcatatttaattaaattaaatatttcaataataataagattttcaatctcactatcatcatctccatacaatttaataaagacgttaaactttaaaaaagttgaaaatatttcattttgtgatattatcgctttttttgaggggacatcttcatataagtccaaaaaagtttgtttattcatagctaaaaatcgtcctgttactgtaataaaaataagtaacgaattttcatcatgatcctttttatgatctttatagcttatttgttcaagataaatagctttattaaaaatacgcatatcttctacaaaatttaataataatgataacggatatgtagctcccacaaaatatactgactttgattcataaattaaatcaactattttttttatttgttctaacagttctgatttattaatctttttttgatataacaattcaatttgattaagaatattatcggcatcaaactgcatatatctaaactcaatttgctctaatcttccttttctagtacttgaaagtatatttttcattttcttaaatgtctctatccccattaaatgacaaaatttatttattgttggtactgaagtatgacaattttgcgataattcattaatagaaatagtttctatttcatcaagatgatctaatatgtaaattgcaatcgaataataaatatcttgattaagtgtattataagtaaaaagcaataaagttgaaataactgtattcatccattctctccttttatttcaaatcagtaacaagcatcatatctaaataaattataaaatctttatataaagtttcatagtatgtatatggaagcgaaatagatatatcaacattttcattagtatcttgaccaataaatgcaattttagctttagaatcatttaaattttgtaaagtgtccatggttatcgttaaaagttctttataatttctccaattcatatatggttcaacaataataataagatcattttcttttaaatcagaaaataaaagattttgtttttttatatcccaacacatattatcaataacatcttttcccatcattaataaataagaagtcgataaatgaaaacaagagatatatttattatgtccataaaataatatttttgaactattttttattaaatctaaaaaattatgatatacatcttctcgtaattgatttttacactgtttaataaaatcaactttaatattctcatatataatcaaatccatatgttgataagattttagaatattatttagttctagtgcttctagcgataactcatcaataaatactgtaaaaccactaaatcctgctctttgacaaaatctaatcactgtcgatttagataaaccagtttccaaagaaattctttttaaacttacttttttcagattcaataaattttttagaaaatattttgataaaataaattctatcgaatctgtctgtgccgtgttatttaccatctttaatttatctattaaatacatagaacacccctttataactgttaagagtttttattattttgaacaaagctattatataataagatccaagtttatcccctttgtttattaacttgatatttatattttatcacacaaaaaaataaaaatacaatattgatatcgcattatactataactaaaatacatagtaaaaaatgatttaatttaataaaaataatccaaaaaaaagctataacaaataataaaaggaatcaaactctttcctaatcagacattttcaatactggaaaaatttgattcctcatactaatctgttataactattctttatttgtatattatttaactataaattttcaccattacttgcaattacttttttataccaattaaaagatttcttctttcttcttgaaaaatcgccactaccatcatcatatttttctacaaaaataaatccgtaacgtttagccatttctcctgtagatgcacttactaaatcaatacatccccatggtgtatatcctatcaaatccacaccatccaataccgcctcatgcatctgctcgatatgttgacgtaaataatcaatacgataatcgtcattaatacttccatcttcttcaatcttatcatacgcacccaatccattttctactatcattaaaggaatatggtaacgatcatagatttcatttaaagtaaaacgtaatccttcaggatcgatttgccagccccaatcacttgcctttagatatggattagatactccaccgatcaaatttccttccgccatttctttattgtcatctgccgttccgcaacctgacatataataagaaaacgtataaaaatcaacacagccttcttttaaaattttcaaatcttctttttctattttaatatgaatatcattttgatcaaaataacgctttatatatcctggatattcacctcgcacttgtacatctccacaaaaccaatttttaatatgattcatttcttgacatgctagcacatctttaggattacaagttaatggatacatagttgcaaatagctgcatgcatcctactttattttctggattgattttatgcgctaatttaactgcttttgcacttgcaacaaattgatgatgtaatccctgaaatcgaagttgaggaatatcaacttgatgcataaaatctttagttccattatttaaaatcccttgagataaaaacccgccaaaaggacctgtagcactattgatttcattaaaagtaagccaatactttacttttccattataatgattaaaaattacttcacaatattttataaaaatatcaatcatctctctagaagcccacccattgtatttttgcgttaatgcaaaaggaacttcataatgagaaattgtaactaaaggttcaattccgtattttaaacactcattaatgacattatcataaaattctaaacctgctttattgggtgttttttcttcaccagtaggaaaaattcttgtccacgctatagaaaaacgaaatactttgaatcccatttctgcaaataacgcaatatcttctttatatcgatgataaaaatcaatcgcttcatgacttggataaaaagtcccttcttctaatactggtgtaattcttttaggagtagtatgtgttcctcctgtacaaatatctgagcaagatattccttttccaccttcttgccagccaccttcaaattggtttgcagcagtagcgcctccccacaaaaaatcatttttaaatgccatatttcctcctttattaaatacagaaaaactaaaataatacagttattaattcatcattaacttttgtttctcttttatcagtctttattaaatctaacatatctttactattagtaatgataattggtgtttgtgttaaaaaaccagctttttcaacctctttaagatcaacatcaacaagtaattgtcctctttttactttatctccttgtttaatatgggcgctaaatcccttacctgccatttgaactgtatctaatccaatatgaattaaaatttcaacaccactttcactagtgattccaatagcatgtaatgtaggaaacaaagttgttatcgtcccgtctactggagctactactcgtccattagttggaataattccaattccatcacctaatgcccctgatgcaaatgcatcatcttttaactcagataaagaaacaacctttcctgtcattggtgataaaatagtttcttttgttttatttgatcctacttctctttttttttaatatcttcaacacttgaattatcattccagaaaaaataagttaataaaaatccaataatcattgaaacagcgatagaaacaaatgaataatacatagaagttgcatcaccagctggtgaaataaaacttactgttccaaaaatccctaatccaccaattacaaattgttgtccgccaaggaaagtaaatactcctccagcaatagctgctgcaatacaagcaaatataaatggtttcttttcaggtagtgcaaacccataaattcctggttctgtaacaccacagattccagaaataatcgctggaatagttaatgcttttttatctttatcttttatttttaaatacattgcaataagtactgctgttaatgcaaaagttgtcccaaattgtccaactaaaattgtatcatatcctaaatttgtaacattcatgattgataatggaataattgcccaatgtaatccaaatactactaaaatttgccaagcaaaaccaacaactgctcctgttagtacaggtgataaatcataaattgctgcaaatccttgagtcaataaatctgtaaataatgaaattactggtccaataactaataacccaattggtaaactaataattaacacaaagaatggtacaaagaaattttgtaacatttcaggaataattttctttgcatatttttggactaacgatgcaaaagcaacgataagtaatacaggaacaactgtacttgtataatttgctgctacaaaaggaattcctaaaaatgttgtaaaataatcaccaactagaggcagtgaacctaatgcctccccagctgctgctaaagtatcagcttgaatagccggataacataatgttgccccaatcaacattccaacaatcaaattaacattgaatttcttagcagctgtataccctaatgcaatcggtaagaaatagaatatcgcatcaccaatcgcatttaatattgcgtaagttcctgttgagttaaaatctgaaccaagtacaaacgataataacgcaactagacctttgataatccccgatgcacataatggccctaaaattggctgaaaacatccactaacaatatcaattagtttattaaacgctcccttaggtgcctccttggaatcactttgtgtttcattactgattcctaagacttcacaaacatcagcataaacctgtggaacatgattcccaataacaacttgatattgtccggcactatgcataattgttacaacaccctttgtactttttaaaacatcatcatttgcttttgcttcatcttttaattgaaaacgtaatcttgtaatacagtgagtaacacttctaatattttcatgtccacccacatttttaataataactcttgctaaactttcatatttccccataaaaggtacctccattaattttcgttttatatttttaataattaattgaggatttggccaactaaatgtaaccactctaatttattatctatttctacttaaagacattatcagttttattactatatctttttatatctctattttaaacacaaatactcataagtcccctctaactatttttgttatagaactacaggtttagccaactaaatgtaaccacccatatttttaaacgtatcacctattacctccttttatactaaattttatataaaaatatcattttactttttaaaaagacatttttattttcttaaataatatatttattaaaaactaagttctagtcttgtatacaactctttcaatatgaatcgtcaaatataatttctcttcatctgataattcatatttatattttcgatatataaaattagatatttcatttacacaatgatatgcatttttatatttaatttttaccatatctaatagtgaaccatcatccatatctttaaaagtttttccacttattaaacgttgagcgaaaaactttaagtgagtaataaatctataataatatacagagttttcatcaaattctatttgaaacttatatttaacaatattagatatttcctgcataactttcgtgattgcatacatattttgcatactatcttcatctatttcagcgtttacaatatgtaaagctataaaacctgcctcatcatccggtaatcgaactttaaactttttttctatcatatccaatgctgtcattccgatatcaaactcacctggataaaatcttcttatatcccataataaagcattttttatataaatcccctcaagatatctatccaccgaagtataaatgtgatccactaatgaaacatatatcatttcatttattctttttcctaaacatgctttactataaacaactatttcttctgtaatttctaaatattctaaaggtatatctactaccaactcttgaagtttattcaatgcaacactattagttaaggtgaatactttttcaatctttttcttttctatctcatcgccaatttttttatgaaatgctattcctctacccataataattttttcaacattatttttatcttttacaataattacattattatttagaattttatcaattatcatgctatccccctttctaaaaagtgtttataaataaaagttaattaatagaattacccctatacaataatattttatattctttatatttacaattcactatattaaaattatacaaactgatagtttattgaggaagagttttttggtttacgagtataaaccttttggttaatacaagatctaaactaaattaataaatactaaaaagcatatcaattattaaacaataatttaatatgctctttatactatataaatttatcaaaaattattttttaaatatctaatgcatatgcaattgctaatttggctgtttcttcaattgcgctaacatggcagcgttccttaccatgagtatttaaacaagccattccaaatgcagcagcatatacattatttcctgctctaattgcagcatttgcatctgttccataacgataaaaaatatcaacacaataatttatatttgcttttttagcttgagaaataattctatttgttaaacctcgatcatatggtgaataattatctttagcacaaatacttactgtcatctcattaccatgataatcagggccaattaatccaatatctaaagccacatattcacttacttctggtggtacataggctcccccatgaccaatttcttcatataatggaaaagcaagtaatgttcgatatttaggctttaaattatttttatttaaataatcaatcattgcgaataaagcagccacagcagctttatcatcaatatatcgtgatacaacataacctgattcagtgtattcaaaatgaggatcaattgagatgacatccccatgctcaattcctaatgccataacatcttctttactcttaacatcttcatgtaaaataactcgcatgttattttcattacgatctaatgttctagcatcatcaaacacatgaactgaatgtgatttacaaataaccataccacgataatgacgcccatcacgagtaatgatcgttacgccttctccttcaatacttgaatagttaattccacctaattgacgaacttctaattgcccatcatctctaatatgacgaacaattaatccaatcgtatcaagatgagcacccatacatactgtctttgagttatcttcaccttctaatgtaatatagccagttcttttacggtcataagttacttcgtaaccatattcctttgcctttttttctaaaaagggatgaatttcctcataataacttactggactaggaacattaataaattccttacataaattaacaatttgttctctatcaactgaaatttccatttttatacctcttttactttctatcatttaaacagataacatgcacattgatgtcccggttcaacttctattagctctggtttaactgaatgacatatttccattgcttttggacatcttgtgcaaaaacaacatcctttaggcggattagctggactagggacatccccacctaatacctctttatcatctattctctctttagaaattcttggaacagcagaaaataatgcttttgtatatggatgtagcggattactgtataaggcttttttatcagccatttccattacatttcctaaatacataactaccacacgatcagctatatgtttaactacacttaaatcatgtgaaataaaaatatatgctattcctaattccttttgtaaatcttttaataaattaataatttttgcctgaatcgatacatccaatgctgataccggctcatcacaaatgattaattttggttgtaaagcaatagctcttgcaattccaattctttggcgctgtcctcctgaaaactcatgtggataccgatacatataatccaagtttaatccaacttgtttcataacttcaacaatacgtgcatctcgctcttcttttgttttgtattttttagcaatatcgataggctctgcaataatatctttaactgtcattcgtggatttaaagatgcatacggatcttgaaaaatcaatttaatcttctcacgggcctttgtcaattctttaccttgtaaagatgtaaaatcttgtccatcaagatatatctttcccgctgttggatcaattaaacgaataacacttttacccattgttgatttcccacatcctgattcaccaacaactccaaaagtttcaccaactttaacttcaaaactaatatcatcaaccgctttaacaaaagatgtagcttttcttaaagaagatgtttttattggataatatttctttaaatgttcaacttttaacaaaacatcactatttttattttccatctattcatcctcctttttccattcactatgatatttccagcagcgcacttgatgattattaccattatcaatcatcgctggacatttttcatgacaaatagatttagcatacttgcatcttggtgcaaaaaaacatccttttggtaattcgtacagcattggaacagatcctggaataacctctagatccgcttctctatcttcatcgatatctggaatagaattcattaatccgactgtatatggatgtagtggatttttaaataaatcttctacgtttgtatattcaacgatcttaccagcatacataacaataacattatctgccatttctgaaataactcccatatcatgggtaataagtaatactgacgaattcatttcatatttcatcttattaattaattttaaaatttgcgcttgaatcgttacatccaaagcagttgttggctcgtcacaaattagtaacgatggcttacatgaaagtgccattgcaatcatgattctttgacgcatccccccagataattgatgaggacatgacgcaaaaactttttctggcatcggaattccaactaatttgatcatctctaaagctcgtgctttagcatcttctttagaaatattttcatgagttaaaattgcctccattatttgctttccaactgtaacaactggatttaaagatgtcattggttcttggaaaatcatagaaatttcttttccgcgaatatcttgaatttgacttttagattttcctaataaattttcacccttgtagatgatttcaccagatgtaattttacctggtggagacggaataagctgcatcaatgataacgcagtcatactctttccacacccagattcaccaacaacacccaaggtttcaccctgatgaaccttgaaattcacttcttgaacagcaggtaatgcaccacgatctgtaaagaaggtaataccaagattcttgacttctaataattctttattttcattcatttttcttacctctctacgatcttaattttggatccaatgcatctcttaaaccatcacctaacatattaaatgctaaaactgtaatgatgatagctaaaccagggataacactgaaatatgtggcacttctaatatatggttgtgaaaaactgatcattgaaccccagcttgacatcggaggtttaactcctaatcctaaaaagcttaatgatgcctctgacattattgcattaggtattcctaaagttactgtgacaatcaatgtagataaacagtttggtaatagatgtttcatgataattttgaaactgcttccaccactaactttacaagcatcaatatattccatctttttaagacgcataacatcaccacgaatcaatcgtgctgttgatgcccagcttaacaatcctaacgctaaataaagattgattaaacctggccctaaaacgaacatgattgccattgcaaataacaagaacggaaatgatgagaatacttgaataacaaatgaaatagcggcgtcaactttaccaccaaaatatccagcacatactcccattgtatatccaataactgtagcaataatttgtgaaacgattcctacacttaatgaaattctgcaaccataaacaattcttgaaaaaatatctctacctaaatcatcagtaccaaaccaatgttgagcacatggtgccattaatttatctgttaatacctgtttatctggatcataaggagcgatccatggtgcaaaaagagcaactaaacaaagcaaaataacgataaataaacaaaccatagccactttatttttcttaaataaattccaactgattgaccaataactgtgataagttttatttttctttttaaacatattatgatgtctcctttcctaaacgaattcgaggatcaaccacagtatataagatatcgacaactaaatacataacaacacatataaccgcaatatacatgactccaccttgaacaattggcaaatcacgagtattaatactatcaactaacattttaccaattccaggaattgagaataccgattcaaccaatactgatcctgttaaaatattacctaaatcagtaccagcaattgtaataattggaatcaacgcatttcttaaagcatgtttaataataacagcgcgctgtttcaatcccttagcctgagcagtacgaatataatcctgtgacaaaacttccagcatactagttcttgtaattctagcaatactagctgcatatcgtgttcctaacgcaataccaggtaaaataaatgaagcaaaactatttatccccgaaagcggtaatagattcagctgtaaacagataacgatttgtaaaataatcgcaatccaaaatgcgggtgctgaaattccaaatactgaaattgtcatcaataatgaatctagccatctaccgcgattaactgctgcaacgacacctacaaaaacacctaaaacaacagctaaaacatatgcaatacctgctaattttgcagtaactgcaaatgacgaagttaaaatatcaataactggtttattttgaaaatatgatgttccaaaatctccagttagcatattttttagccaattaatatattgaatatagataggctgatctaatcccatttcatgagtaacacgggcaatagttgctttatctgcaaattctcctaacattatttctaccggatttccagggactatattcaatacaaaaaaagtaatcaacgaaatacaaaaaacgacaccaattgcctgcaatattcgttttaataaataatttcccatatttttcctcctttactatacaaatgtagaatatggaatgcatgaaatgcattccatattgtcaactctgtatttgcaatcttattttttatctaaatcaatatcatataaatgatagattaagttacctaattttgcatttttaacgtatggttttgcaacgaattgtaattttccatagtatagaggaattgtaccataatcttcacgtgataaaatataatctgcttctttatataattcagcacgtttttcatcattatcaactgtttgtctagcttcttccatcaacttatcaaattctggattattatagaaaacacctttaccaactgcattttctgaataataatatgtatacatttgattatcagcatctgcatataatgggaaccagccaatcaatgttgcttgtaaacttccctctgctcttgatgatgtccaaataccagaatcaataacttctacattcattgtaatgccagcttcttttaaatatgcttgaagtgctgtagctactttttcatcatttaatcttactttacaagtaaattcaggattagtaactccagcttcagctaataattctttagctttatcaacattatattcatatggttctaatgtatcatcatgaccaggaactcctggatttaagaatgacgtagcaggttctgctgcatcatttaaaattgttttacataattcatcacgattaatagcaagtgagattgcttctctaactttttgttcatctaaagcaggatcagttacttttaatgataagaaatatgttccaagtggtgtgatctgtgtaatttcatctttgatcttactatctttatattgatctagtaaattaacgtttaagtcacacatatcaatgttaccttgttcatattccatcatttttgtactgttatcatcaatataaacaacttctaaacgatctaaatttggtgttcccccatgatagtttttatttggttcaaaaacaacttttgtctgttcatcattttcagtaataacatatggtccagtaccaattaagttagttcctttaccccaatctttacctgctttttcgcaagcttcatgaggataaatagaagcataatccatacctaaatttgcaatgaatggtgcaaacttatattcaagtgtaattgaaaaatgtaaatcatcttcaactttaatacctgctaactcagtagcattaccagccaacatatctttagcaccaacgatcatatcatacatatatgtacttgttgccccagtttctggtttgaacattctttcaaatgtatatttaacatcttcagtagtcaaatcactaccatcgctaaattttacaccctcttttaattcaaaagaataagtcaacccatcttctgatacttctggaaaatctgttgctaatacgcattcttctacattatcatcattccagcgatataatccttctaatacattatcggcgactgatgaagcacctgagtttgtattagtttgcatatctaatccaactttaggattagattgcccaaaacgaaaaactttttcgtcgctttctgtatcattgccaccactgcatcctacaagtgaaacagtcatcgctgctacagcaaaaacagaaagcacttttttaaaacatttcatccttttaacctccctgtcttattttaaagctatctttcccataattttctaagatatctttcttaccatattacatcaattttcttgaataatacggatatattatatcaaatcaaatttgtcctttcaagattgcccacataaaatactgtatctttgtatacattttcacataaaaatatcacaaaatatttgttttaaacaaaaattatcgaataaatataggcttattcctaaaaaatagttaattattattttatccactcattgctaacttcaactaaaaacaatactctcatcttttaatttgaattaacatataagtatttttaatcacaaaaaaaggctttttagcctttttcttctggtttattttttttctcatagtagtttcttactaacatctgtgtttttctaatatgaagttgtattttttcttttgctagttctttatcacgagctaaaatagcttcatatatttcacggtgttctttagctgccgaaactaaacgatcaggttggcgaattgaatgcctagaagttacatgaatataataatttatatctgttaataactgttcaaaatattttgattgggtacagcgataaattgcttcatgaaaagcaatgttaatttcattaaatttctcttgatcaccctttttagcataaaattccatcaaatcataaacttctttaattttttctaactcttcatcatttattctttcaattgccaattgaattgcaagaccttctaaagcatgtcgaatctccagcatatcatcaatatcacgatgtgaaaaacctaaaacataaacacctttattaggaatacttttaactaaaccctccagctctaactgttttaaagcttctcgaatcggtgttctagaaatgtttagttctttagatagagcaacttcattaagtttttgtccttgggtatactcctcatttaaaatcttatcacgaagtagagtaaaaattttatttcctaacgatccatgtcctgtgttttctaataaattttttgccataaattaccctaactttcttataattgcagctgtaaattctgcagtagaagcacttccaccaatatcaggagtaactgttaccccttcttctactacagctgctaatgcatttcttaatttattagcatcttctagttttcctaatgcttccagcattaaagcaaatgctaataacaaagcacttggattagcgatgccttttccagcaatatctggagcactgccatgaactgcttcataaatccgatattcatcgcctatatttccacttggagcaaatcctagaccacctactaatcctgcacataaatcagaaacaatatcaccatataggttaggtgctactaaaacatcaaatgtttccgggcggatcactaactgcatacacatattatcaacaattacttcttgtggctcgatttctggataatctttagcaacagctctaaatgcttctaaaaataatccatcagtatatttcatgatattcgccttatgaatagctgtaacttttttgcgaccattatttttagcatattcaaacgcataacgacaaattttttcacttgcttcacgagtaattagtttgatgccattagccatatcaggattgatcatgtattcaattcctttatatagatcttctgtattttcacgaatcattactaaatcaatattttcatagcgtgaattgattcctttaaaagatttaattggacgaacattagcataagtagcaaactgttgtctcaaagcaacattaacacttctaaatcctgttccaattggtgttgcagttggtccttttaaagcccatttatattctttgattgcatcaactagacctggttcaaatacttcttttgtattaactgcatattctgctccggcttgatattcgacccattcaatatctaaatccatcgccttagtaatatcaacaacactctttgatatttcttttcctattccatcacctggtattaaaacagctttcattaaaattcacctcctaattctttgattgcatttaataacccaccataattgatcattactttttctcttggtgataatgtaagactagcttcgattgattcattagtagtttcattaattacttttactttaccattatgttcaactacctctttaatattaacgattttgtaactatcttgatcattaaagaaatcttgatctttagcttcgataactaatggtaaaataccattattaattaaattagaacgatggattcttgcaaatgataccgcaaaaatggctttgatttttaaataatttggcacaagagcagcatgttcacgagaacttccttgaccataattatcaccaccaacaatgaatccaccaccattagcaactgctcgatcatagaattcaggatccactttactaaatgagaatttagctaaatgaggaacattagaacggtatggtaacaatttactatctgaaggcacaatatgatcggttgaaatattgtcaccaacttttaagacaactttaccactaatttcatcagtaattttatcaccacgaggaaccggcttaatatttggtcccatataaacttcattattttcatcatattcatcaatgaagaaattaccattttttataaatggcgtatttggtacctcatctaaatacatatcatcttcaaattcatctgacatatatcctttaattgcacttaacgctgcaacctctggtgaaactaaataaacacttgcatcattagttcctgaacgtcctttaaaattacgattgatcgttcttaaagatactcctttagataatggcgcctgccccattccaatacatggaccgcaaccgcattcaagaattcttgctccagcatgaaccatatccgccaaagcaccattttcagataacatcgctaaaatcgagctagaccctggcgcaattactagtgaaacatgatcagctactttacgtccttttaaaatcttagccgctttcatcatatcggcaaaagatgaatttgtacaacttccaataacaacttgatttaccttcattccttcaagttcttttactggtactacagcatcaggactatgtggtttagctgtcattggcactaaagctcctaagtcaacagtcaattcttgatcatacgtagcatcatcgtcagccttcatctcaacatagtcttcaactcgcccttgttgtgctaaatattctttagttctttcatcagttgggaaaatagaagttgttgctcctaattcagctcccatattacaaattgtcgcacggtcagtcaatgataatgatgcaaccccatcacctgtatattcaatgatcttattaacaccacccttaactgttaattgttgtagaatatacaaaataatatctttagctgacacccatggcgctttttttccttttaaatttacttttaccactgttggacattgcaaataatattttcccgttgccatagctacagcgacatccaatcccccggcaccaatagcaatcattcccattgccccacatgttggtgtatgtgagtcagaaccaactaatgttttacctggttttgaaaaattttctaattgtaattggtggcaaacaccattacctggttttgaaaaaacaataccatgtttttttgctacactacgaataaattcatgatcatccatgttttcaaaacctgtttgtaacatgttatgatcaatatatgcaactgctttttccacagcgacatgtttaatattcattgcctctaattgaagataagccattgttcctgttgaatcctgtgttaatgtttggtcgatttgtattccaatctgttcaccaggaataagatttccatctttaagtttactgcttaaaattttgtatgccaaattcatacccattgcgatatacccccgtcttctctatattgcatacaattatacaaaaaaacaatattgattacaaccccttgaccaaaattttaatataaatgtttttttaaaaaaacaatatatttatgatagtaaaaaattaaatattattacttataaaaatatgttaaaatacaaacggtgataaaaatgttaatcgaatgttcaaatataacgaaatctttccagggtatccctttattaaaggatataacttttaaagttgatgatcatgataaaatagcgattattggtgtaaatggagcaggcaaaacaacgatccttaaaattatttctggtgaagaagaatatgatggtggtaatcttttttgtaacaaggaattatctttaggatatttaaaacagcagcatgatttaaatatggataaaacagtatatgatatcggtttagatgtttttgccccattgcttgctattgaaaatagattacgtgaacttgaaatattaatgagtaatgatcatagtgaaaaaatactgagcgagtatgatcgtttaactcatgaattccaagaacatgatggctatagctatcctagtaaattaactggtgttttaaaagggttaggctttaatgaagaggaaatgaagcttaaagtatcaatgttgtcaggtgggcaaaaaacaagattagcacttgctaaaatgttattacaagaacctaagttattattgcttgatgaacctactaaccatcttgataacatggcaatcagttttttagaaagttatttaaaaaactatcctcatgctgttataatcgttagtcatgaccgttattttattgatcaggtttctaataaaattattgaaattgaaaatggtaaatcaaaaacatataaatgtaaatataatgaatattctattttaaaaaagaaacaacgagctgttgatttaaaacactatttaaatcaacaaaaagaaataaaacgcatccaacaaagtatcgatactttaaaatcatataatcgtgaaaaacaagtcaaacgagccgaatcaaaagaaaagcagttagctaaaatggaacgtatcgaacgtcctgaaaacttacctgatacaattaccataaattttaaaccaaaaagagaatcgggatttgatgttttaaaaattgaaaatttagctgttaaatttgatgagatactatttaaaaatataaatatcgaaataaaaaaacaggagcgagttgcccttgttggtgataatggtattggtaaaactactttatttagaactattcttaatgaattaattccttttcaaggaaaaattaaatttggcagtaaagtagatttagcttattatgatcaagaacatcaaactttatcaatgaataaaactatttttaatgaaatcagtgataattatcctaaaatgacaaatacggaaattcgcaatagcttagcattatttaactttaaaggtgaagatgttttcaaagaaatttctttgttatccggtggtgaaaaaggccgtgtcgttttaactgaaattcttttaaaacaagcaaacttcttaattttagatgaacctactaaccatttagatattgcatcaaaagaagttcttgaagatgctttaaatcaatttgatggaaccatcttttttattagtcatgatcgttattttattaataaagttgctactagagttatcgaattaactaataataaagcgataagctatgatggaaactatgatacatattttagtaataaaattattgataaaccagtaaaaaaagaaaatactgattatcaaaacatgaaacagcaaaatgctttatatcgcaaacaacaaaataaaataaaaaaagtagaaactaatatttctaacttagaaaatcaaatcaatattttaaaccagcagttacaaagcgaagaagtcttaaataactatcaaaaatacaaccaaatcaatgatgaaattgctttattagaaaatcaattaaatactttaatggaagaatgggaagcccttcaataaagggctttttatactttcttgacatttaaaatacaatagttctcatccacacctgatccttcacaatctacataattaacttttacaagacaattcgtcttcttattattatcacataaagaaactagatcacctttttggatcccctcttctttacaaacaatcaaatgacttatagaaccattatctatcatattaaaactactactatcaactaacaaacttatcattaaaatactcctttctgttatgaagtgacctttgtcaagtgaaaattacacattcataataaaattatttaattttatcatcaatggcatacaaaagccccaaaatactagatttatcgacagttaaccactctgttatacggagattggctactccaaggttaatggttcgtcaaataagttctaactatctatatacgtgaatcatctataatttatgatattccagatcgcgacttcttttatatcttatttatgccacaaagaaaggaccgtagataactaaacctgcttctccttttttgaggcttttctatgccattgattttgtgttctttttttctcgatttttgtcctccatttcttattttttctttaaattttcataattgtatagaaaacatctttttacatcttctatattcttcctgtttccattccccatataaatcctgctagttcccttgccactgccatgatagctacattatatggtttccctcttaataccatccttctaaatcttttttgtaatctttctactgccttatctgcatatgctacgatttcatcctcctgtcctttttgtctttttttcaacgcttttgatttctttccaactgttcctcttactaatgcctgtgtacattctaccagtgtctttctaaccatcgcgttccccatcttggtgattggtgtattgctgtatttctccgcgctcgaattctctcctggaagcattcccagattcgccataaatgcctttgctgttggaaatcgctgaaaatcactcactgtgacatgtatcttcattgctgataatgtatctattcctttgaaacaggaaattttagaaaccggttccttatattcctcttcttttgaaaactcttctatcctttcatcatatttttcaatacgttcatttaaataatcatagacttttaaatattcatttaatgtttctcttacgattactggcaattctatcgtttcaagccatttgatatgggccactgtccagttgcttttcccctcatatcttaatcctcgtctcaataccaatgcactgatctgctgtttgattctctttcttgactggatgacatcttctcttagacctatatattccttgatttcattgtcatgttctgttggtacatgaacagctttgtatgaatcgtgcataagattagtggcaatattaaaggcatccatcttatcattttttacttttttatttttgactgatccatgcattgttgatggtgctaatataacacatggaatatcatggtatgcaagttcatgatataaggaaaatcctaaacatccagcttcatatcctgttaaaatatccacctcattttcttcactcattctttctttagctgacttaataaatttaagaatattctttacttcagcagcacattttgtctgtgcaataacttctcctgttgatgaattgattccacataaactgtacgtatttttatggacatccatcccaatataaattatacttttcatagtgacctcctattgtcgttatggtatcgactttcataattttgtttttttactaatcttattatgaatcgtaatccactttttgacaacttaggaggtcacttcatattatctaataacttagcaaaaaccttatctaaaagtcttatactatgtagtcataattagttgattaattttctaccattaattttaatttcaatcgttttatctagattattttccaataataagatattttcttttttcacttcctcatttctttgacaccaaatctgccaaagaggatatacaataaatcttaaagttactgctattgctaaaagacctagagtaatagatacccctaagatcaatggtttaattaacatttttaacctccaaaattgactatctacctaatttatattcatgaaatattattttatgcaattaatcaaagactacctattaaataaaccatatttcatgtaaatattttgtctaattaagacagataaataatttttatattaactaaaaatagagtcgataaatttatatcaactctattacatgtttttaatttatataattttccataaatctagttaactctctattactgatacctatttcttttaaccaatcattaaaatcctctaataatacatcagcatcttcattttttgatattatactattgttatttatttgcacgatcaactcattatccgtacatattgataaattacgataataagttaaaccgcctattatcactaagaccattattattaaaactaatcgtgttttacttaatctgaatatacaatctgatcagcagtccctttaaaaattgaatcatgactaataacgacaatagttttactactactttgccttctttttaataacttgattaccatttctctattcctttcatcaagcaatccccgctaaaactaaatcacattgctttaataacaatcgccactctttactactcaccatctgaacaccctatcttaaaaatgctttcctgattaaagaaaagtatttttataatttaatttttattgctaatcataatatacatcggtattttttcttttcagcatcaataccatcactggctaaaactggcccatttatcgaagtagtattcctcaatctaattatatatctgaactgccagtacacttacctacaatgtgcaatgttcgttgtccatcaggtttagatattgtcatttcagcaacatttcttgataaattacattctatccttacatcagcaatataaatagaattttgccaatataattaatcctaaaacagatatcaataaaactcttttttatttactctttcgatataatattatctcttatactccttaatatttttaaatatagttatatcttaataaaatattagtatattttacacattaaatccatacgcttagcaagaataacacattttatatgcaaaattaaaataacattaaattattactttttaaaaatcagtaatattataattaatataatgttattgacagataaaaattactttcctataataattttataaataagagtatattgattaatatactactagtggggatggggataattatgataattgcattagttgataataatgaacaagaattagaaatttctagttctttgattgaaaatgagatacagaaatatactaataattatgtcattgataaaatcaatgaccctaatatattagatttaaataaatattatgatgttttgcttctagaaattgagatgataaaagatggtattgaactagccaaagaatatctcatttatcataaaaaaacaaaaattatttttattagtaatcatattgatagattttttgatatttttgatgttcatcctttttactttattaagaaagataatttgaaaatatttatttcaaaagtcatcaaattattaattaataaaataggaattgataacactcatctatctattaacactttgtatggtttaactaatatagcgctgaataagataaaatatatcaaaagcgataaacattactgtttaatttttacaacagatgaaatatataaagttcgtgatactataaataatattcttttaaaaatagttagtaaaaatttctctcgtattcatcaatcaacaattatcaactggcaatatgttgaagaattcaagtataatacaattaaaattgatcaagagtatttatcagtaagtagaacttatttatctgaatgcaagaaagcatatacaatttttattaatagtccatttaatatcaattcaaaaaatttaagtaataatgttgataatgaataaaaataattttgagaaaattcttatgttataaatacaaaactgaagcgctataaattattacagcacttcagttttctacttagttaaagtaatcataaccttaaaagttatttcactatgtccttttttgtatttttcttataaataattatctttgttaatttattaaatcgttataattcgatcagcataactaaaaagagttttatcgtgagttaccataataatagtttttccttctgcatgcatcttagatattaattccataattaatatcttattttcatcatccaaacttccagtaggctcatcacatataattatatcaccttgtttcaataataatctggcaatcgcaactctttgctgctgccctccagaacattcataaaccagtttatcataactatcttctaagcctactttttttagtttttcttcaattaatttttttttgctttttctatgtcttttagatggataaattaattctaaattataaccaattgttgcattgtcgattaaagcaaagttttgaaataaatacgatatttttttacttaacaaatttgatatctgcttacttttataattgatttcttcgtcttcgataaatattttacctttatcaggcttatctaataatccaattatattacataaagtagattttccagaaccgcttttcccagagataataacaaactcacccttattaatttctaaactaaaattatcaaaaatattatgattatcataactttttgaaatattatcaatttttacagctatcactattcatcacttccttttaataaattaacagttgttttcttatcaaaattcataatcattatactttcaataattatttcaaagaaaaccataaacattaatactattaatgttatcaagatattattttttaataaaaacacatttattgaaaatggcaataaataagctattaaattaattccataaatctctttataccttctaagaaaatcatatcctaatagttttttcaaagataattcttttgctttttgactaaaatataatttcatatatatataaattattatagaataaacaattaaatatattgacatatataaaaataatttaactactgtagggatagtatagtaagataacgtgtcatttattaaatcactagcatttactaatcttatctgatcagcatcaatatactcagaaactaaatcgcgataataagacatttctttattattgcttaataaaagattactataattatatttaatatctccatcagtaccatcacttaaaagaatgattggatcttttatattatcatgattattacttattaaattttgataaatatgatgtttttttaaataaaaaacttcacaatctgtgccatctttatactgatctagcatctcacctttatatgcctctggaaccaatagagccggacttttaacatccttatattcatctaaatataaatccaaataatttctgtttacaattatatatggcaattctgtttctgccccaccttcactataaaagaaacacgctaaagtatctttttcttttaaaagggtcttcatagcattaggatcatctgccatattttcaactctataatatttatcgtatatttccttttttgccaacaataaacttgtctcattcccaattgcccatatatcaacaaatgagtaaaatactataatacaaagaagtattgtaattatatttttaaataaaaaacttattttcaataatatatcataattgacagatttcttaatatttatatttcttactaacatcaaataacaaccaatcactgttattatgaaaaccaatacaaataatagagaattacttagtatatctttaataaaaattattccacttttactaaaactacctacaaaaattatccataaaacaacattaacaataacaaaaatagaaattatccttaaaacaaattggaaaaagaaattataaaaaatatctttttttgaataacctaataattttactacacctacttcttttttcaatttaagaaattcattaatgatacatattagtaaagcgataacactgattatcagtattatgtaaatatcctggatatactcaatttgttcttcatactcctcttcactatcaagtggagtataatttattagaccatcagcaatatcagcaatatttttttctacttcttttatatcttcattatatatattataaattatataattattcacattacgtagttcactaataaaattattaaaatttgtatattcgtatacatctccatctaaatatatcgaacttgttgcctttaagtatccacttgcctttgtatcatttatatcagtagttatatacccattttctaacgatactgcctctactttataaccataattttcatttaaatattttaaaattatgttatcacgatcataaatataattgatcttttttattgttgatgaatccgtatttagtaattgacttgtggctaaaatatatttattacttttacacaatttcaataattcatctagaaatcttttattattttccaatgactcattttcgataataattcgataattttctttatcacttattttatttaccaagccatagctaacttcgtttagtgtattgatatcattttgatttttatttataaattttattgaaaaacttagtgttgcaagcagaactactaatatatacattaattttttcattaataggcccctttctaaaaaatagagataaatttctatccgtaataagctgtataattatgtttatgggcactactacttgaacctaaggcaaaattcacaactgcttcaactgttctttttgtactagttgtgctagcatatgttgtattatcaccaacaattacacgagcagttgcatcagctagggttgaagaacatgatactcgcgttattttagttaatattgttacacaatctgtactccctactgtacttctccaactgctgctttccccgcattttaacgtttttactccacttgatgaagagaaagttataatttcatctgccaaaacacccgaaatacacacaaacatacatgtaaatattgcagttatcactaaatattttaatataaattttttcatcatttttcctccttttttatcataataattttttaattcttttttgccactttcataaagtaatagtattacttatactatttataattttcttgaataaaaatatttaacaaaatttataattcttcccaagattgaatcttgtatacaacttattttgtttttaaataatactattattggcttaatttataatatttctattcattaatctatattcctggcaagaatgacataatcttggcaagaatagcataattttttataataataaaatattattaatatcaaaaatctaaaactttctttgagattgagcattttaattaaaaacaacaaaaaatacaagaattaaatgatataaactattatctgaaaaaataaaatgatagattccaaataagatcctttcttactttaggataaatgttaaataaatataattattttttaatctcttattagttattcattattatgtaaaagtcctgaaaatctaaaattaaaagtcagacattaaatctgacttaattaatagcttctttatctgtttctccagtcctaattctcaaagcactttttaaattataacttataattttaccatcgccaggatttccagtgaaggcagctgttttaatagcttcgattgtttttgcttcccatttttcatcactaacaataatttcaaatttgatcttaggcaacatattaatatctacttgatttcctcgaactacctcacgatatcctttttgaattccacatcccataacctgatatgctgttataccatgaacttcaattttcgctaacgcttcttttacatcttcaaacttttcttcacgtacaaatgcttctattttaatcataagtaatctcctttaatccaatccattaaatgatggataagcagtttcattatgctcagccatatccaaacctacttgttcatcgcgtttatcaactcttaatgttgtgaataattttacaattccaatacaaattaatgttccaataatcgcaactacaattgtaactaaaatactaataatctgggcaacaaataattgggtatcaccgaagaataacccattccattttgctacaccattaattgaagtttgagcaaataatccagtagctattccaccccagattccaccaacaccatgacatccaaatgcatctaaagcatcatcatagccaaaatgttgttttacttttgaaatcatgaagtaacaaattggacttcccactaaaccaataatcaatgatgcccaaattggaacaaatccagcacctggtgtaattgaaactaaaccaactactaatcctgtaacacttccaactaaggttggtttatctgtcatgattacatccatcaacatccatgaaagcattcctgcagctgctgaaacagcagttgtcataaatgcatgcattgctagaccattagcttttaaagcacttccagcattaaatccaaaccagccaaataataacagactggcacctagtactacaaatggaatattatgaatacgatacttcgcatgatcataatccttacgttttcctaaaactatacataaaatcaaagcgctgattccagaactaatatgtactacattgccacctgcaaaatctactgaaccgatttctgctaagaaaccacctataccccagaccatgtgcgccataggataataaacaattgtagaccatgcaataataaaaataaataatgccttaaatttcattctgccagctactgcaccagttatcaatgctggtgtaattattgcaaacatcatttgaaatgctgcaaatcctaaatctgggatagaatcagcataagctcctgcttctaagctaacaccactcaatcctaaaaaacttaaatcgccaataacaccaaaatgatcgttaccaaaagctaaagaatatccaaataacacccacataactatagctattccgattacaaaaatggatgtcatcatggtattaacaacattctttcttctaaccatacccccatagaaaaatgctaaacctggtgtcattaataataccagtgctgcacaaataataatgaatccagtatctcctgaatttatcatataaaaacccccttttattttataacagagagtatatatgatattttattattatgcaatatattttttattatttttaataaaaaattttcactttttagtttttgttacacaaaaagtacctataaataaactttctcaaaatacaaatatcaaatcacgatatagtcatttgatattcatgactaaaaaggaatccaattttataattgaattcctttttgtcttcagatcattccaaaaacgttattcaaccaataatactttttcataaaactattttataatccattgatccttataatctctaaaacacaaatcaacatccctaactgaccactttccatctttattatacattactgcaaaaccatctaatttttcatctgtataacttaaacagacaaaataatgatctttataaacgaacctaaccaaatcattaaattccactaaatcataatctttcgccaattcttctttgcttatactcaaaaaatcaatatcatcaatttcaagagttgatacattttcatcgacatccaaaccaatataactaattaacgcattttctttatctaaaaaatcaacagttccttccgtatcagttatagcataaattttaggtgccataattcgagtaaataaatatattatgtctctacgatcagtttctatataaccaagatctgtaatatcatgatatgttgatgtttctaattgtatttcaagagcattaattttaattaacggcttatcacttccagtttgacaaaatttaaatattacaacgataccaataactaaaataatcaaactaattattatctttttcataataatccccctctcctggtatagctctaaggcgcagataaagttttgctttttgctggtattttatattcttattgaaaaatcttatactaaaagcataaaagttaaattgtagatttctgcaccacgttatgttaaaacaagtgcaaagctgatacgaaaactgataattgcaatagttaccaaaacactcccaaatacattaatttctaaatattaaaaaattaataaatagttatataactagactatatttttacctgcaagataaaaaatcaatttctgtcaacaaaactgattaagatctatcacatgaatttcactaaaaaattaaatcctccaaactataaatctttgaaatcaaaaatcatttaaaaaattcacatagccaatttttaaactcgtttctatgctctttatcaacaattaaactatcttacataatttccttttactattagacaatattactacaactcaactaatttacaatttttaactatgttttaattatatattcattttttattatttaacttatatctttataatttattatatcctttaaatatagttatatcttaattacatattaacatattttatatactaaagccattttttggcaaaaacaacttaatcttggcaagaacaacataatttttattttacaacactaaaacaaccttgatatactaataaaaatctttaaaaatattaatgaaaatcattctaaatgtcataataaatttctttaaaattccagcttactcaacaattattttagcaccataaaaatagagtacatctacctaaagaagtatcataaattataataacataaaataaaaacacctaattaaacaggtgttttttcatatcttaattcttcttggataatagtctgtttttgaaaatatgtttttgtttccaaaacaacttcttttctaagcccgatcaatcctattaaattaggaattgccatacaaccattaacaatatctgcaataacaaaaataaattccaatgacataaaaggaccgattgcaataaaaataatataaataaatttataataaggaattgcttttaatccctttaaataatacatacatctttccccataataattccagccaattattgttgtaaaggcaaagaaaatcaaaccaatattaacgatatacttaccaactgtcggaataaataatcctttattaaaagctagtgttgtcattgctgcgccttctaagccactagtatgactattagttaataaaatagctaatcccgtcatggtacaaataacgatcgtatcaataaatgtccctgtcattgaaactaatccttgttctacacaagaatcagttttagctgctgctgcagctatcggtgcacttcctaaaccactttcgttagaaaaaattcccctactaattcctttttgcatcgccattgtcattgtaatcccaattccaccacctaaagcagcttgaggcttaaaagctgattgaataactaagcctaccacttggggaataacagttatatgtgtcaacaatataattacgacaccaccaatatacaatacacacattaacgggattaccttttctgcgacatttgcaattcttttaattcctccaatcgtgataaaaccaacactaattgtaagtaacacagcagttacaactggcggaatattaaatgatagttgcatggcatcagaaatagattttacttgtgtaaatgtacctattccaagtaatgcaactgctacaccaaaaaaagcaaacaatttagccaaaaacttacttcccagtcctcgctccaaataatacattggtcctccagccatctgatcattttcatctttaactcgataacgaatagctaacaaaccttcagcatacttagttgccattccaaaaaaggccgaaacccacatccaaaataaggctccaggtcccccagcagcaatcgctgtagcaacgcctacaatatttcccgttccgattgttgaagataaagctgtacatagcgcttgaaaactagaaacatctccagcatcattatcctgttttttaaaaatacagctaaaagccagctttaattttgtcaattgtagtaattttaatttatatgtaaaataaattcccgttcctaacaataaacaaataagcggcattccccacacaaattcattaactttttttaataactccgtaataaactccataaaaaaactccttcttaagtaattaagtcggaattaataatgaaaaaactattcatcctgctgtccttttacctgagagtttcaccataactggtttgctccttcggtgttcatataaatgaatctctccagcagttcgtccaatagcgatccttttacctgaaatctttaattcttcggtgttcatttagaatctctttcgccattatcatccgatatacaagtagtattatacgctaattgtatacaattgcaaatattttatgaaatattttaaatctttattgtataatattaaaacattatatcagatcatattttaattatagaactcccgagtttcgaagcagttattatactatcatctatgccaagtccttatcctacatgggattcaggactttttttaatgtcaacattttgttctttttgtgttgtgtattgttatattttgtggtataatgttcttggaggttggtcgttatgtttcttaaagtcgctaaatttaaaaatggtcgttcctttctttctattgttgaaggctatcgcgaagatggaaaagtcaaacagcgtgttatcaaaaaaatcggttttctcgatgaactcgaaaaaaattatgaggatcctgttcagcatttcaagaatctcgctaaaaaaatgacagctgatgccaaggctgattctactttttctctttctatagatcttaacagttatattgataatggttataactgcctgaatgttggatatcttccttttaaatatatctacaatcagctcggcctcaacgatttctgcataaataagcaaaaaagactgaatatccagttttctctgaataaaaatcttgaacttcttgttttttcaagaatactttatccctcttcaaagaaatcgacattcgaaaacagaaatcttttctttgccccttttgataatggtattaccagagattccgtttatgactgtcttgactatttttatctctataaaaacgatatcctcaagctcctctgggacaaatcaaaagatttctatcaaagagactgctcaaaaagctattatgactgtacaaactactatttcgagattgaatacaatgatgatgatattattgatgaaaatggtgaaatcattgaaaaaggcatgagaaaacgcggtccaaaaaaaaacaaaagacccgaccctattattgaattgggacttttgatggattccagtggaattcccatgtcctatgatatttttccaggcaatgaatccgaaaaaacatcattaagacctatactgaaaaaaacaaaagctgattttggtatagaacgtaccatcgttgtagcagacaggggactgaatacatcagataatatattttatattgccggcttcaataatgatgaaaattcaaaaagagacggatatgtttatggacagtctgtaagaggagcagacaaggaatttaaaaagtgggtacttgatgaaaaagggtataaaacagatattattgatgaaaacaataaaaagattgcctttacacataaatcaagagtgtattccaaggaaatcaaaattacaagagacggcaaaagaaaagtaaaggtcaatgtatgtcaaaaacagatggtttatttttcattcaaatatctcatgaaacagcgaaacgacagaaacagaatgatcaaaaaagcaaaagagatgatcaaaaatccagctggatacacaaaagcaacatcatacggtgctgctggatatatcagtaatatagaattcgatagaacaaccggtgaaatcaaaacagaaaaagaactctttttagatgaagaaaagataaaagaagaagaaaaatatgatggatattattccatcgtaacaagtgaaattgaactggatgactacgaaataagaaaaatatacagaggtctgacaaaaatagaagatactttcaaagtcagtaaaacaaatttcgaagcaagaccaacatttgtgtggacaaaagaacatatagaagggcattttctaacatgttttacagcacttgtcatgataagactcctagaaaaaagactgaattataaatattcggtagacagaataatagaaactgcaaaaaaatacaactgcataaacatagacaggaacatatatcagtttatatataatgacagcattataaaagacatatcagaagaatttgatattgatctcaataaaaaatacagaaaaagagatgaaataaaaaaattattaaaatattagaaaaaagagaaattacactacatcaaaagtaaaaaaacaaatcgggtgaactccttatatatcaaggggtttacccgattttatggcatttttacttctaaactcaagatacaattgcaaatattttatgaaatattttaaatctttattgtataatattaaaacattatatcagatcatattttaattatagaacttaaaatatttgtctttttatatctaattacttataatattagatatgaaaaaattaaaatactttatacctgctatattatggatgatttttatttttattatgtcacaaaccaatggtaatgattcatcaaatcaaagtaacttctttgtagaaataattttgaaatttattaatattgatcgaagtatattagcgcttttaattagaaaaacggctcatatgagcgaatatgcattactattattttttatttattatggctttaaaaaaactattacacatcaatatactttattactatccttattaataactttcttatatgcttgtagtgatgaatttcatcagttatttattcctggtcgtagtggtcaatttgtagatgttttaatcgatactgctggtggcacatttatgttactaattatctatttatggcaaaagaaggctaatcgttagacttcttttttaattcttcaatactttcctttaatttatcgattgcttcatttaaaacctcaagatcattttctttattgttttgtcgagactctaaaacatcagcccaagcggcatttgaagctaaaatatcaccaactacattgaaccatgctcctagagctgcctgttcatcaatagtaaaatcatttgttaataaataacctaaaataactgctgttccagtaaaactaaatggatctatatcaggaatatacatagttcacctcttttatatattattatatgctggttttaaaaaaatttatgggcctcatgtataattttttatatctttaacataatagaagtaggtgaaatataatgaacgataacgttaaattattagattttatttatcaaaactcccaaatgggagtagaaactattgatcagctggaaaaaatcgttgaagataaagattttaaaaattatttaaaggaaaaatatgaaggttatcttaaaattcataaagatgctaaagaaaagttacatagtcatggatatgatgaaaaaggtctcagctcatttgaaaaaatccgtacttatttaacaatcaatattcagacactaacagataaatcgactagtcatattgctgaaatgatgatgattggcagtaccatgggaatcatcaacgctattagaaatcttgcagattttaaaaatgcccaagatgatattttgatgttaatggaaactcttaaaaaatttgaagaaaagtcatattctgatttacaacattttatataaaacacaaataaaggttatgaacatttaattcataaccttatttatatactttaaattccaaataataaatctacataagtaggaattggccagtactgagcatcgactgattcttcgatagcatcaactgtttctcttaataactgcattgttccaaatacatcatcacgccaagcaaccgcctgagtaaaaatatcttcctctgatttttgtgcagctgcaatattattttctaatgttgtcatttgttctttcatcactttagtttgagatgctaatttattaacatcatcaactaagaattcaacatctaaacctgcttctttagcagtaacaacttcagaagaaagttttgctaaatagtcacaaacagctggataaatttgtgtttttgccatttttaatgctgttaacccttctacttggattgttttaatataattatctaataaaatttcataacgagaagctaattcaaccttattatatactcctaaacgatccaacatttcgatattcttttcatcttttaagcattttaaagcatcaacagtatttttattgttaggaagaccacgtttttcagcttctttttcccattctgctgaataaccatcaccattaaagataattcgtttatgttctgtaataaattctttaactacatcatcaaatgatttacctgcttctatttcagctgccattttttccattgcatccgctaaaatagcattcaaaatagtattaggacctgctatagattgacttgatccaactgcacggaattcaaatttatttccagtaaaagcaaatggagaagtacggttacgatccgtattatcttttgagaaagtaggaactactgataccccagttgcaaatcgtgttgcatctgttttattaattttctttccttcacaaatttcttcaactaaagcttctaattcagctcctaagaacattgaaataatagctggtggtgcttcatttgctcctaaacgatgatcatttccagcactagcaatactcatacgtaataaatcagcatattcatccacagctttaattgtacaagcaagagttgctataaatggtttgttttcaattgggttggcacctggattaaataaattgattcctgtattagtaataacagaccagttatcatgtttaccagaaccatttactccagcaaatggtttttcgtgcaataagcagcgtaacccatgttttttagcaatatcctgcataatttgcattaataaatgattattatcagatgttatatttactttagaatatacacaagctacctcgtgttgggcaggggcaacttcgttatgtttagtttttgatggtattccatatctccataattcatgatctaaatctttcatgaaagctgaaactttacgtttaatgcttccaaaataatgatcttcaagctcttgtcctttaggtgccatagcgccaaataaagtacgacctgttaattttaaatctattctttgttgatagtattcatctaatactaagaaatattcttgttctgcaccaactgaagcagttacctttgtaaccccctcaacacctagtaaaggtaataatttacaagctgcttgtgataaagcatcacatgatcttaataacggtgttttcttatccaaagcttctccagtataagaacagaataaagttggaatatacaaagttccatcttttacaaatgctggtgatgtacaatcccatgctgtataacctctagcttcaaaagtagcacgtaatccccctgaagggaaagaagatgcatcaggttctccctttctcaatgttttaccactgaattctaatactgcttttgatccatctggttcaataaaggcatcatgcttttcagcagttaatcctgtcattggcataaaccaatgtgtaaagtgagtagcaccattttctaaagcccatattttcattgcattagcaattactgtagcgcattctttagataattcttcacctttatccaaagatgcatggaatgctttgtatatagatttaggaattcgttctttcatcacatcatcactaaatgctaagcatccataatcttctaataacttattcatttccattctaagttcccccttgttagtttattaacaacacataaccatacaatatatatatgtttatatgccgttattatacagttactttttttaggtgtcaataattaaaatgatatttttttatcattttgttattaaattattatttcgataattttttagtttcacgtctgcgttttttctcaaccttatgatgttcattgtacaatttcacctgacaatgcattcgcttgttaacttttattaacgcttcacaaatacccattatatctttaggatatataactattcttttaccaccttctaaataaagttcaagcgctttaggatcgataataatttttgtcattttaggaatcggatcacataccgtttcacaattcataatattaatttctttatcccttccgatcctcttgcatatttttaaagttcttcgtttaatcacatatttataaggtcgcataaaatatatatatccaaaaataattgctcccgctaaaacaataacagcaaaagcttgaaaattttgatgatatagcataagtagaccataaataacataaaaaactgtgaaataaattaaagctgtactaaccttcttatcaaacaccttttcatgatatattctttcttcttccatagtttcctcgcattcttgttatcattataaccaaacatttaaattataacaattgcaaatcccagctttaatctatattcttacaagtatgtaaaggtctatatcatcatttttttatttttaaccaaaattacaatttagggtacttaaatatttttaagtaccctaatatataattaataaaaatcgacgaattattgggccacaccggtaacttgtttattttgcattctttcatatataataaagaaaggtgtataaactaaaacagagactaccaataaaattccttgggttacagctcccattggattagctcctgtagctataaaaccaaaaataatcggcggggtcgtccagggggcaatcagtacaacttttggacagaagtttatcaaagttaaaacataaccaattgtaattgtaataatcggagctaaaacaaacggtattcccaaaataggatttaataccatcggaatcccaaatatgactgtttcattaatattaaataagctaggaacgatcgataatgttgcaactgcataattatcctctcgcgtagaaaaaatcaaaattgcaacaactaagccaatcgtgactcccgaaccaccaaactctcctgtcatttgtaaccactgcatcgtagaaatattttctactgttttatgagctttataattttccatattttgcaacgctaggggagtaaatagtgattctttaacagcagatagcatattattaccatggattcctactaaccaaaataacataattattaaataaatcacaattattcctggtaaagaagctcctatactagatagtggtccttgaacagaagtctttattatatcattcaaatacaatacatttcccgttaaattttcactaataatattacatgtaagaccacatagcgcaatgataataatcgtaatgattgcgggaactaaatcttcaaatacccgcgctatccctattggtactgtttctggcattctgatttttaatgaatctttttttactaaccaacaaaataattcaatagaaacaattcctactatcattcctgtaaacaatcctgaagcccctaaggcatcttcagaaatacctgtgaataactgtaattctcctttctttgttaattctaatgtttttttagcagtatctactagagcataattataatttgtctgtgttatcgataaccaggcagcaacacctaacataccggggaaatatccagctttctcttgtcctaagttacgactgccaatttcttgagcaattccaaatgtaatgccaacggtaatacaagaaattgccgcaaaattaattgcatcaaatgccggatttaaaaattcaagtaccattattggtttccaaatagctcctaatccgctatccgtatttactaagacatttgaccataataccccaactgcaccggcaattattaaaggcataaatgattgaaatgcatttttgatcgcagataaatacttattttgtccacaccaggtaccgacgcgaccaagaatatctgccattctatccatattttttcctccctttaaatacttattgacaatattagtataaaatttatatatattaatgtcaatcttttcccttgctataaataccatactttttcttaaaaaatactgatattatattgtgctaagcttataattcatttttcccttttttgattattatataataagaggtcaaacatcttttagcattttttatcaaaattcaatatcctactcaactataaaaaagcacaaatctacataattcgtgcttcaaaaattactttataacttaaaagaattatttatctctaatcatttcatattacatagctactgtaactgttttaagctcaaaatctcgataatggaatcgtgataatgaatattcaaaaatagtaccactgctcaaataagcaatttgttcaatttgaaaatatggttctgtagattttagagccaaataatcttgctctaattgtgacgatatatgaccactcacagttttatggacactttgaatttttaattttaaagttttttcaatatattggtagatcgatccttttaaatgttctatttttaaattaggtataattgatataggcatataaataatttctatagaataaggctttttatcaagatttcgtcgtctaattatatgatagacaaatgtcccttcttcaatctgcagctttttagaaatttcttcatcacaaggaatcacttcaaatacaattatatcactatctatttcctttattcctttgaatctctgtgtcagtcctattttattattagtcaaattagggctttccatcgaaggattataatctttgacaaatgttcctgctccccgtctccgaactataagtccttctttgactaaaatatctaatgcttttttcattgtttctttattacaatgataatctacacataaagaatattcatatggcagtttttgcccatatacatatttttgattttttatcttatctcttatatcattagcgatatctatatatttagccatatttcccctcctatcctcttttaaaaatatcatatctttgttaaatttgtatatactttttatgataaaagactactaaatttagcagtcttcttcatctattttaatcaaatttaatagccttaacaacttgaccactaaattcctttattaaaaactcattactttcataaattccataactattattaccttctttaggtaaagaaatcgatgatggattaattatatatattccattttgatatttagccacttgtttatggatatgtccataaacaaaaatatctccagaatttaaattaggaagattgttttcatcaaataaatgtccatgagttaaaaaaaagtgatgattatcaacatctatagtcgcataatcagctctaatcggaaattctagaaccatctgatcaacttcagcatcacaatttccccttactgcaataattttatttttatagtcatttaatagtttaattacttttttaggcgcatatccatctggcagatcatttcgtggtccatgatataaaatatcacctaagatcactaatttatcagccttttctaattcatacatttctaatgctttttttgcatatatataagaaccatgtatatcggatataaacattattttcattttaaaccaagtcctcctctactggatatcgtactatcgttttcaaattttctggagctacacgctcaggtttatttaaatatatttcatgatgtaagccgcttaattttaaattagcaactgtaatatattccataatttgtttagttgaatttatttccgtgttataaggacctatatgcagcatttgaatacactcaccttcttcaaattctttcaaataaacatctaatgtaaaataatcgccagttttcaataaaagctccattttaatttcttctaatatttcttccgtcaatattggcggctgtaacatcattaaagtatatttgatcatcttttttcttgttacatcaaaatgactgttgtcataagtatcccaaattccctctaatttagccccactaaaactaatctcttgtttttgataatattcttttaaagacttatttattaaaaacaagagttttgatttatttctaaattcaggaacggttggattcccaataccatctatcgctatatactttaacttcggcactactaaactacttatttttttagtcattgcccgatataactgtggatattctttttttatatcatattttttcactgtatcatccccaccctcatattatattacttttatcacaaaatactataaaaaatcaacaagtttattaaaaacatgactttgcactcttaattataaaagcgccttagaaaaacttttatcttggcgctttagctgctatttttttaaatattggtcaaaaatactttttattcctgtttttgatgcaaccccctcatgtaacttaacctttccatcatataaagcaggaacataataatagtcatattgatcagctagttgactatcaagctgctcatcaactaattcaatttcaatcttacgatactcaggattttcatctttcaattccttgatccaatttatagctcttctacaatgaggacaatttttcaaaatgaacattctcatttttctaccctcttctaattgtcttgattacgattggtgtattaggacaatcttgcatatttcttggtgcattagcaattttatcaacaacttctaaaccttctgtaatttttccaaacgctgcatattgaccatctaaatgtggcgcgtcttcatgcatgataaaaaactgtgaagaagcagaatctggtatcattgtccgtgccattgataatattcctcgcgtatgtaataaatcattttttatcccattactactaaattcacctttaatactctttgcttcatgatgattaaaatctttatcataacctccaccttgaatcataaaaccaggaataacacgatgaaaaatcaaacctgcaaaaaaatcctgatcaattaaattcaaaaaattttctactgtaattggtgcaatttcaggataaagttctcctttcattactcctccgtcttccatttcaataacaatttttactgtctccattacttttctcctttatcaactattctggcttcaataacttcatttgccatttttttatcttttctctttttattaaaaatcaaacctgcaataataagtactgcaagtataactagcaccatgataatcgaatcaaccagcttaaactgatacgctgtcgctacaattaaacatagatttatgatctcaaaagttcctgataatttatgtcgaccattaaccataaaattaagagctaatgcagtacaaacaaacattgctataattaatgctacctccatcttcatcctcctcataatattccatcattataatcgttattttaacaaactacaacctatttataaatactttttccaacatataccatatcaaaacttttatttccaaacaaatcaccaataacattatcatattgttcctttacaatatctagattattcatccaaaaatcactatttattagcagtcttattatatcatgatttttatcactttaaataaagtcattcttaaaaaaacttatactcatcttaataactttaatcttatattctattatttggtatactcaataatcatccgttcaagctccttagcagctaaacttaatgactgatccttacgcttaatataacagacagagcgaagcggtatttcctcttgtaatttcaaacgaaagatatcatcttcttcatcctttaacaactcttctggtataaatcctattcctaaattattttttactaatggtaaaatctggtcagctgttgcaacttcaatatctggtgtaaatggtaaattatttcttgcaaaccattcgcaataaaaatcatatgtttttgttcgcttaccaagtgaaataatcgaatgttgactcagttcatataaagaaatatttttcttagttaattcatcgaatgctttacctccaatcgcaacctcacaatagtctttaagatgatgaacttttaatgtttttgtatctcctgttggtgtcgttacaacagcaatatctaccaagccattttttaaagcagtaattggctgtggtgtcggctgatttaaaatacgtaaacgaactccaggatataactgatgaaattgattaagtacaggtaaaagaaaacatcgtaaagcaacctcacttgtcccaattgaaataataccactttgtaatgttttatccatcgataataattcttcacccaactcaatctgttctacagcaattcgaatatgtgaatataatttttctccttcctgggtcaacttaacaccacgatttgaacgaataaataatgtacagcctaattctttttctaaatttttgattattctagttatattaggctgattattcatcaaagcaatcgcagcttgggtaaaattctgatactttacaacataataaaaaacacggtaatattcatagtttatattcatattctgtctctctttaatatataaatttaatataattacaataacaaatatacatttttaatatttcaatataaatattataatataatcgtcatcatataacaatgactttcttaaataacatcaaagggggctaaaacaatgaataaagacttgactgtgggaaaaccatctactgttttatggaaattttgtttaccattatttggcagcattatttttcaacaattatataatatcgctgatagtttcgtcgctggaaaatttatcggtgaagaagctttagctgctgttggtaatggctatgaaattacattaatttttattgcttttgcatttggctgtaatattggttgttctgtaatagttgcacagttttttggggcaaaaaactatgccaatttaaaaactgctgtttatacaacactaatttcaagtggtgttgtctgtgccttattaatgctgcttggtcttgttttttgtactgatcttttgcatcttatcaatactccagccaatattatcgctgattcaaaactctatttagacatttatatatgggggttaccttttgtattctattataatgttgcaacgggtatcttttcggcattgggtgatagtcgaacaccatttatcttcttaatgatttcttcactaacaaatattgctatggatatcatatttgttactttattttcagaaactttttcaagaggtgttgatggcgtcgcatgggccacatttttatgccagggagtaagctgcatcttagccctgatttttgtattaaagcgtctcactaaaattaaagtaactgaaaaagttcctcttttttctaagtcaattttcaaaaaaattgctattgttgcaatccccagtattttacaacaaagttttatttcagttggaaatattcttattcagggaattatcaatactttcggctctagtgtcattgctggatattctgctgctattaagttaaataatctagtcattacatctttgacaacattagccaatggcatttctaattatactgcccaaaatatcggagcccaaaaactagaaagagtccatagtggttttaaagctggactcaaactagtatggcttttagatattccttttgttcttctttacttttttgctggtaaatatctcatttatattttcattgataaagcaacaactacaacaatagatgttgggattacttttttacgtattgttgctccattttattttgttattgctgcaaaacttgtatctgatggtattttacgtggtgctgaaatgatgaataaatttatgattgcaacttttacagatttaattttacgagttgtttttgcaaaaattctctctagctattttggtacaacgggtatttggatcgcatggccgataggctggtctgtatctatcgtattatcaatgttgttctatcgtaacagtttaaaaaatgttcatatataaattagtgaaaaaatacggtaagagttattatccttaccgtatttttatatcatgattttcatctgttataattgaaatattatcatttatctaaactaaaaactttttatttatgataagtttcatttttaataatcttaaaactgcgataaatttgttcaaccaaaatcaatcgcattaactgatgtggaaatgtcatcttagaaaaactcaaccttaaattagctcgatcaatcaactcttgtccatgacctaaagaaccaccaatcacaaaatcaattgtgcttttaccagataacatacaatcttctatctgtttagccatttctatagaatcaagttcttttcccgctacatctaatagaataacataatcatcctgtttaattttatcaagaatctttcgtccctctttagattttatgattatttcattagctaaagaacaattatcaggaatgctttcatcagcaacttcataaacttcaaccttgcaatacccttgtagcctttttaaatattcttcaacaccggcatttaaatatttttcttttaacttacccacacaaataattttaatcttcataatttcctccactaacaacattaacttgactagctaccttaatattatcaaattttatattattttcatcaaatatatttttatatgtttctaacgctttttcttcactattagcttcttcacttaaatgagctaaaactatttctttagttttatcaccaattatttctgccatcaatctagcactatatatattatctaaatgtccagtatccccttgaatccttctttttaaaaaatatggtcgattagttgccatcaacatttcaacatcatggttactttcgataatataataatttaaattttttaaatactgtcgatttttctgtgatacatatcctgtatccgtcatatataaaatactttccgtcttcccttttatcacaaatgccaatgggctagtggcatcatgggagatacttaacggcatgatttcataatgtgctaacttaaatactttataaggatttatttcatgacttttatcaattcctttaatacaccctttgccacaaaaacaaatactttgatcaaaaatactaatatttttattatgatcataatgatcatgggtcaaaagaacataattaatattttcttcttgaaaaccaagtttacttagtttaaataataattgttttctagtaattccacaatctattaaaattccaataccatcatcatatataaatgtactgttacctttagaaccactagctaaaatatgaaattccattaactcatcctttctttgtaatttattataacataaataatttttataaaaacaaaaaagggacaactgcccctcatttgtaataaattatttaaacccgtattttttattaaatttatcaacacgtccatcagcactagcaaatctttgtttaccagtatagaatggatgacagtttgaacaagtatctacacgtacttcatctaaaactgatccactttcaaattcgtttccacatgaagtacaaacgacttttacttttttgtaatttggatgaattccttttttcataaatttatatctccttccgccttatagccttactgctacaaagtaagtttctagtgtataataacattaataaatcattatttcaagtatatttacaaaatattgatcaaatcttaaaatttataaaaacatttttataaattatccttttttttaatcttccacatgacgtcttgtaataactgcccctaaagaaattagtttatgatcaatgttttcatatcctctatcaatatgatatacatttccaatctcggtaactccatctgccattaatgctgcaactatcaatgcggcaccgcatcttagatctgtcgcatatacccttgctccatgcaatggagttggtccgtttacataacacatcgcttcttcctgatctatctttgctcccatcgcattcaattgataacaatgcccaaaacgttctggatatatcgtctctactacctgagataccccctgacactgcgtcaataatgcggttaatggctgctgtaaatctgtggcaaatccaggatatacctgcgtccggatatctaccgctcttagattctctttcccgccatgcactattatactatctcctacgatatccattttgactcctatttcttttagctttgatgtcactgcttctaagtgctgcggtattacgttttgtacgattactttttctccagctgctgctgctattactaaaaatgtcccggcttcaattcgatctggtattatttcatgattacatccacttaatttctctacaccttcgattattatggtatctgtaccggctcctcttatctttgctcccattttcgtcaacagattcactacatcgattatttctggttctttggcagcattttcaatcgttgttttaccttttgcttttacagccgcaagtaaaatatttatcgttgctcctactgatgcaaagtctaagtatattttattccctatcagctctttggcttctattgtatatgttccatcgctgctatatgcaacggttgctcctaatgcttcaaagcctttgatatgcaaatcaattggacgcggtcctaaaaaacaacctcctggcattttcattgtaactttattacatttccctaataatgctcccatcaaataatatgatgctcttaatttatctactgcctcgctaactaatggtctattttctaaattagtaggatctactactaatacatcttcatttttttcaactttacagttcaattctcttaataatacccctaatgcatcaacatcagaaatatttggtactccatatacagttacaggactatctgctaagactattgctggaattagggctactgtagcattttttgccccactcaccactactgttccattcaatttatgtccaccttcaatagcaattacttcactcattttagtcctccttataatttaatctacgtaactactatatattaatttattgttaaaaacaaccaaaatttgtatttttgaacgattagaattttttgacaattttcgtatatttttatttttacaaaaaataaaaatttcaaacattttttaccagataataaaagaatccctctaagcgggattctttaaacaaattttagtataaattaagctttaccaatgcatccaaagatttccattttttctttaacacattctttgatagcttcagcccctggtgctaataatttacgagggtcaaatcctttaccttctaaatcttttcctgcttcgatatattttcttgttgcttcttggaaatataattgacattcagtatttacattgattttagaaacacctaaattaattgcttttttaatcatttcttcaggaattccagttccaccatgtaatactaaaggtaattttccagtttcttgttgaattgcatctaatgcatcaaaatctaatccagcccagttttcaggatatttaccatgaatatttccaattcctgctgctaagaaatcaactcctaagtcagcgatcattttacattcttttggatcggcaacttcacctttaccaattacaccatcttcttctccaccgatagatcctacttctgcttcaacagagacacctttagcatggcataactcaaccatttcttttgttttttcaatgttttcatcaatagaataatgagacccatcaaacataattgaagagaatcctgcttctaatgcagctttagctccatcatagctaccatgatctaagtgtaaagctacaggtacagtaattcctaaagaatcaaccattgctgctaccattgctgaaacagttttaaatcctgtcatatattttgcagcaccttctgatacacctaagattactggtgctttcaattcttctgcagttaaaagaatagattttgtccattctaaattattaatgttaaattgaccaactgcataatgtccttcttttgctttatttaacatttctgttgctgatactaatcccataatatttctccttttctttttactcctatataatactattatttaaaaaaaatttctatagtaacacttagatttttacctattttattcatttttatccaatgtaagcaattactttattttattaattatctttaagcctaatttatcttaaaacttccttagatttaaatatatctttagaaaaatgacataacgtaattcctaaagccatcgataaatttaaagaatcaattttttcactatggggaataaagatactttgaccataatcaagaaattcatctggtaaaccactgctttcattcccaaacaccaatgaatgactttgctgatcaggttcaattaaatgaatatttttagccccttttaacattaatggatatatgttgtgttgcggatatttttctatatattcatcaaaactatcaaaatattcaaaattaatgttaaatattgctcccatcgacgctcggataactcggggatcaaatacatctacaccaggtcgaatgatcgctaaattaacataattaaaacctagcatcgttcgaatgatcgttcccatgtttcccatatcactaggatttactaaaaccacatgattagtatcatctaaacttaatgtgtatttttttataattgcaactgcaaaacagttttcttttttagaaagtttatttatcgtattatcactttcaattaaatcaattttatttttcttacataattcattaattatcgcaattcctttatttttcgatgaattactttttatatacacccttaatactaaatctggtttattttgtaataactcaattgtttcaaatactcctaatgtatatgtataatcaaaatctttatgatatgctttaattttcattctctaaacctttcaatagatcaatttgtttttttaaatcaagttgtaatgcttcaaaatgcttacgatcataatctacaccctgatcaatcaactttaataaatcattatatttttcataagccaatgtaaataatgagatttgaatttctaaatcaagttcattttgtccgtttgtaacgatctgattgatctctttatatttttctttaaatacttcatctaaatcaacttttttctttctattaaacaaacccattttatacgcctcctaaaacattatacagctaatcaaaataatattccagttttgaaaaaggaataaattttaaaggctttgctttatgctcgcccagcattttttccatccaaatcatatcgtaccatttatccaatttatacccacactgatgaaaatgggctatttgacaatatcctaaccgctgatgaaatgctacactaccttcatcaggaatcgcaatacaagcattcatattcaaaatattttgtcttttagatattttttctagttcatgatatagaattctacctatccctaaattccgataattattatctatataaatcgaagtttctaccgcccaatcatatgctactcgtttttttaattctgatgtataagcatatcctacgatcttatcatttactttagcaactaaatatggatatttatttaaagtattgtttacccgctgtttaaattccgcaatactaggtacatcatattcaaaagttattgcggtatttaatacatatggtgcatatatttctaacagtcttttggcatcttcacattttgctacatctatctttacttccattataattatctcctgctttttaaattaacaacaactatctcactatggttagcagttcgcatattatatccccagccacccataccagatgttacgacagcacaaaaattaccatctttttttattccataattcatctcatttactttaattagttcataaaaataatttaaaggaaaaatctgacctgcatgtgtatgaccagataattgtaaatcaattcctaattctgcattatgcttataatctcttggttgatgatctaataatatcaatggtttgttatcatctaaattattagttatttcttctaactcttttctattttttactgcataatcttttctaccaatcaaataaatatcatctaaacttactgcttcatctaataaaacaataactccgctttcttgcaatctatttactatatcaaactcttttaaaggtgttctgcccttaaaaccaatttcatgattaccctcaataaaataaactggatattttgctgccagcgatttaaatattttcattgcatatgttacttcatctgaagttgtattttcatcaaagatatctcctaacaaaataataccttcaggatcaattgcatttgcatgattagaaattttagttaaatcagttttagaaacaatagtacctaaatgaatatcggaaacaatcattaaagttttatcattaaagtttttatttatctcgatatcatatgttgtaatgatcgtatttttagcattatacataccataaaaacttaagatcaagcttgttactaaaacaataataattccataacgataactaaatttaatatattgattaaatttagttatatataaaataaacctaataatatcaaaaataactaaacaaatacaagcattgaccaaaaaaccaaaatatattaaatcatataaactcaaaacaataaaacctatgataatagcagctgtaataacatttcgatatttaactctagtaaaaatattccgtacatgataagctaaataaattgtcataacacctactaaagtcatttccattaatacaaaccaactcattaatatctctctccttcaagatattattataccatagtttatatttatggtataatgacatcgaggtgaaattatgcataaattagcatgtccaaaatgtcataaaccaattgttcaaattggaaactcttataaatgtgattctggtcattgttacgatatcgctaaaagtaaatatttgaatttgttattaaatcccgataaagctacgaacaaccctggtgatagtaaagagagtcttatagctagaaaagcatatctaactaaaggatattatgatattattttaaataatgttattgattgtataaaaaaatatcgtaatgatagtaaattaaatattttagatttaggttgtggtgaaggatattatactgccggtttaaagaaaatttttaatgatgataatatctatggtctagatatttctaaagaagctattaatatggcaactaaatatactaaagatatatactggttagtaggcaatagtaaaaatttaccgatcgttgatcattctttagattttattactgcattatttacagtcgttaatcaaaatgagttaaaaagagctttaaaacctggtagatatataattcatgttaccgcaaatcctaatcatttaattgaaatcaaacatttaatatatgatgaaataaaagtcaaaagtgataaatatattcgtttagattttaaaaaagttgaaagctatgatttaattcatcaagtaaaaatcgataatcgtgaagatgctttaaatctccttaaaatgaccccacactattatcatatcaaaaaagagcgccgtaatattttagacaccctaaataaacttgatattacaattgatattaaaattacaatctatagtacataaaaattttatttataattaataaagatgatgtaaattattgatcaataatttatatcatctttttttaaaacaatatttttctataaaattattgcgcataccaaaatctcaccattttaacaacattaaaacaatttttttcaaacactattctagctggaattctttttatttccccacaatcaagaaagacaatatcaagtccttctccagtttcctcgtaaccgacaatcgttacccaatgccacaaatcatcacgaatctgacgtcttcgatgcgttaaaatcaataatcctaacggatttgcactatctatactttcctttactaccttcattgctatttcaacatttggttttctcaatatataatatttacaattatctaataatttacttaatctacgcgcatataaatatacatacggaaaacctcttttttggggctccattaatttaaacatctcattcatatgatcaagatacatatctttattaaatgtatgatctttcttcgtataatttcgtataataaagaaaaatatctgtagcactgacactggcacatccagcctttcttgcccaggaatctaaaaaccagtcttgattgccaccatgccctaccaatttatcttctatatatacttttggataatctaaaatcatcatgccaccctctttcattattcatattatacataattctatttgatttagttactaatatgataataaataattatcattatattttaattttctgtattttatcatcctaaaacaatttatatttaatgatttagatactctatatttgtattccctagagattttttattaaaatctaatgttttgttaaaaatttttactacttcattacacttaattaaaatatgatattacttttattgcctttgtactgtttagattcttttacaaaacattataaaataacattgacataaaatactatagatgctattctgaaaaagaaagatatctttattatcaattctgatagagatatattatggtaaacacacttcatagtgtttatataaaaaagaagggagaaataattttatgaagaatttaaacaaatgccttttggtttcatttgtactaggggtaatctattcaatatatgtaatagcatattttggtggtgcaattggtggctcagaaggtactgaacaagctggtgcagctattgctactgcattagttacacctcacatgatctgtacagttttagcaacaatatttaatggattaggtctatttatgaagaaacgtggatttgctcttgttggtgcaattttatatgcagtcgcaatggtcttatttattccatattttatgtttgttattgtacaaatgatcttatcatttgtaggatttgcaaagctaaaaaaagatactgtttaaaaataaaaaaatcatatgttaataatcattcatcctatataatgggatgaattttattatttataagcaaatacgctatatcagatgaaaaaaatatgtaattccaaatataaaacaagattaactttacatggatttagacacagccatgttagtttactcataaataatgggattgatagttttacaattgcaaaaaggttaggacattttaaaagaatggtagaacgagtttacggtcacatgtttgcaagcaaaaggaaagcaattcttaatatactggataacttataaatcaataaaatccctgatgaattttcagggatttttcttattaaaatttaattttttaaaaaaactttgccaaaagctctataaaacgggaaaagtctctttgggacaagagactttcaatatctgaattctatacaggaagtaattttatgtgatgtgtttactttttaattgctttaaaactttcgtttttgttatgctgcaatttaaaataatctttacaaaccgtaatttttatgccaaaaatatgtcacatttatacatatatataataggatatagttttatcaatatctttagtttttttaacagggaatttctttataaagaattttagagatatgatgaaagaagcttgatcaagatgaaataaaaaatcatcagagtttaaaagataagcaatatcagagggaaaatgcttaggaataagtaaaggttgaaagaattgagagaatttaaaaagagatttagaaaaaatatttatattatttaaaatcgttgttatactatccgtgatgaaactccttttttattggttttatggtgaaacaagtataacatggaagttttgtcttttttagtataaaacgaaaaaagatgataaaagagatataatcgataatcattttatcgtttggaatagaaactaataaaagtagtaaatttgtatcagttatactgattttttacactaccaaaataatcatgagatgattttatgaatctaaaggataaaaagaaacaagaagcagaggcaaatactgcggaatattagggattattaaaataaaatacagtattgcttgacttttgtacttcatattagtattctaataatagaaggtacctttcttatcattataatttattttacaaaataataaaataataaaaagtggcaagcgggagccacggaatggagaaaaaatgaataaaaaaattatatcatatttactctgtatatcgattttatttacagtctttttcatagtttctgaaaaacaagtttatgctgacaattctaatgttatgactttagaagaagctattaaattgataaacgatagagtaaactcaaaaaagaaaactaaattttcaactataaacgaaccatatgtatacccaatattaccaggaacaaaagagtgggaaagttttaaatccaaagatgaaatgatggatgcttgtcaaataccatctgaaatagttgactctatgtcaacggaagctttaacactttcagttatcaatcatccattattagatactgaggttctttcttataatgactatacacaaggctttgattcttttgtatctgcttttgatgcagcaaaagcattattagaaagagaagattttgctgttaatttagcaaaaatatatttagacacaccagttttaaataaagaagaatataaagaacaacgttctaactcccaaaatactatgttagatttcactgtaaaagaaacagttttagcagttccacaagtatttaacttattaaaggaagacgaagccgaagcattaattgtaatagcagaaaataaaatgaaagaaaaatcagaaaaccaagaaatgtatggtacctcagttaacaccttttttacagtaagagctaccgtttctggaaaaaataatagaaacggatttgcgactgttttaactcccaggggttcttctgttgttgttattactatttctgatgcggaatttactactcaacaaaaagaacaaataaacgcaacttatagaaaagaataccctcaagcaacaatagtagcatcagcaagtaaaaaatataactgtcattcttatgcatggtatctttcatcaacaagtaatagatactggatggatgatccaagtaaatatatgtctgatggtagttattggaagcttaattattcaaatgtgaaaagtggagcaaaaatgtattggagcggaaaacaacattcggcaaatgtaatctcggttaattcaagtgctgctaacggtaaaaaatgtacagtacaatcaaaatggggacagggtcctataatgaaacataatgaaagttattctccatacaataattctagaaccgtgtggggaaggtaaattaatataataaaaaagcctaggtcgttatgatctaggcttaaactttatatatttattgtttactacaaatgttacataacccacacttagtacactatgggtttttagtttttcttttaatagatactcctgtcgagggtctaaaggctttccattagcatcctgcgctccttttatgacataaactgatttcattacatcttaggttcttttagaatacttttattgcattatacatatttgtaccaaaaattccgtctactgttaagctaaaccctacaccgtttaatctctcttgaattaatcgtgttatgttgccttcacctcctttttttaactataggacaagcatttaatgtcttagatccttttataccatctacaactaatccagctccaaattgcaaatatactggataacttataaatcaataaaatccctgatgaattttcagggatttttcttattaaaatttaatttttttaaaaaaattttaccaaaagctctataaaacgggaaaagtctctttgggacaagagactttcaatatctgtattctatacgggaaaacgaatactattatagatatttgggacacgattataatagcacattattttataaattgttttcaaatgatgaaaattgattttcaaataatgaaaatcaattttatagataacaacttatttctgctcctaattcaaaatatgtttctatatcatcttctgctttaaaaactacttttatataactatcatcaatataacgatatatcttagctgtagttccaggcatcatttcctttttaaaaataacacttatttttttaaaataattattctcaaaaagttcaaacggtaaaacatcaaatgcccattcaatatatctgctgttatttaaatgctggtttacatcaacatcactatataaaacagtccgcttcattataaatgataattccaattcttctttaattttatgaaaagtgtctatactatatttgtatggcacaatctgcggtataataatcccagctttttcaggcctggtaattcttctttttttcaaatcaatcaaagtccataatgaatacacagctgcaatttcttcaccactttcatcttctacccaataattacgcataaactggatttttttatatcctgaagcccttgtatataaattaattaattcatttattttaattggtctttttaaaattattgtttctttagctaaaacaaaaccataattttcagccaattcatcattccaaattcctattttaaatgcatttatagtggccaaatctgataatttagacattagagaagaaattcgataattacctttataatcagcttcttgacattgaactaaaacttttaatgatgaaattttattttccatatttactcctttctgttatgaagtgacctttgtcaagtgaaaattacacattcataataaaattatttaattttatcatcaatggcatacaaaagccccaaaatactagatttatcgacagttaaccactctgttatacggagattggctactccaaggttaatggttcgtcaaataagttctaactatctatatacgtgaatcatctataatttatgatattccagatcgcgacttcttttatatcttatttatgccacaaagaaaggaccgtagataactaaacctgcttctccttttttgaggcttttctatgccattgattttgtgttcttttttctcgatttttgtcctccatttcttattttttctttaaattttcataattgtatagaaaacatctttttacatcttctatattcttcctgtttccattccccatataaatcctgctagttcccttgccactgccatgatagctacattatatggtttccctcttaataccatccttctaaatcttttttgtaatctttctactgccttatctgcatatgctacgatttcatcctcctgtcctttttgtctttttttcaacgcttttgatttctttccaactgttcctcttactaatgcctgtgtacattctaccagtgtctttctaaccatcgcattccccatcttggtgattggtgtattgctgtatttctccgcgctcgaattctctcctggaagcattcccagattcgccataaatgcctttgctgttggaaatcgctgaaaatcactcactgtgacatgtatcttcattgctgataatgtatctattcctttgaaacaggaaattttagaaaccggttccttatattcctcttcttttgaaaactcttctatcctttcatcatatttttcaatacgttcatttaaataatcatagacttttaaatattcatttaatgtttctcttacgattactggcaattctatcgtttcaagccatttgatatgggccactgtccagttgcttttcccctcatatcttaatcctcgtctcaataccaatgcactgatctgctgtttgattctctttcttgactggatgacatcttctcttagacctatatattccttgatttcattgtcatgttctgttggtacatgaacagctttgtatgaatcgtgcataagattagtggcaatattaaaggcatccatcttatcattttttacttttttatttttgactgatccatgcattgttgatggtgctaatataacacatggaatatcatggtatgcaagttcatgatataaggaaaatcctaaacatccagcttcatatcctgttaaaatatccacctcattttcttcactcattctttctttagctgacttaataaatttaagaatattctttacttcagcagcacattttgtctgtgcaataacttctcctgttgatgaattgattccacataaactgtacgtatttttatggacatccatcccaatataaattatacttttcatagtgacctcctattgtcgttatggtatcgactttcataattttgtttttttactaatcttattatgaatcgtaatccactttttgacaacttaggaggtcacttcatattatctgttatttttagatactgagctaataataatgcaaaaaactttaattgtatagctgttgttcataaaaatttaaagttttttatgttattatttatataagagaattattttattactttagaggtaaacaaaaatgagacgtcgaataaataaaaaaagagttgccctcatagcaattatttttacaatcattatatcaattatcatatacttaataataaatattatctttctaattagtacaccaaatacatctgctactcaaaaaacaaaaaaagctcctaaaaaagatcctcttacatcactaaactattatttgccttcacaaaaggagcgttatgaaaattataaaactaaatatcctgatttatcagatgaagaagtagttacatatgtcaatatgaatttagattacaatttttatgaccatattattattcaatctgatcctagtgctttaaatacacttgtaaacaaatattatcgattagataacaatttttctccgtcagaccttgtttatattaatgatggttataccagcactagtgatcctgcctacaaatatcgtaagcaccaaatgtcaagtgtcgtttataatgattttgtagcattaagagatagatgtcgagaaaaaggaataagtttttatgttgtcagcggttatcgctcaacagcggcacaggaaaaaagttataatcatatggttgatacttttagtgttgatgaagccgataaaacatgtagtcgtcctgggcatagtgagcataccttaggtctagcctgtgatgtagctttagacaattgctcttttgaaactattgtcgaacatcctgactatcaatggtttgctgaaataatatcagattatggatttatcatacgttatcctgagggtaaagattctttaactggttatagctatgaaccttggcatcttcggtatttaggaaaagatctagctaaaaaagtagtaaagagtaaactaacttatgatgaatattatgctcgcaattttatgtcttaaatgacttatatataaattttagcaattttaatgtgtaatatttgacgattttcttgtataataatattattgaaagaaggagtatatttaatgaatgctatttttaatatcttaccttttttggtatttttagctctattatggtttacatatataaacatttcttatggcatcatcgtacatcgcactaccaaagatgatcatactttaacttcatgtctcagtgattctgggaaatatttctacatagttttattgattttttatgcctttacgttttgtatttgtttaacacttataattttaaatattattgccagcaatttagaaggagcatatgcaccattaaacatccttactattgtaacattagctgtcagtattttattacaacagattatctatgtaggtcatcgacaaatgatgattggtaaaattaaattagattatcgtaaaataaaacgtgttacatatcctaaagcaaaaaaacttagatttgtttatggacaaaaatcatttgaaacttctcttcgttttatagatgattttaaattaaaaagggcattacaaaaaactagataagtaatataaaaagaataataatatgtatacaaaaaagaagaattagtttaatgtcattaaattatttgatgactatcgaagagtacatgaaagtgtacccttttttttcgctcaatttactatgaatgatattcaaggctttatacaataacgcaagaaaaatcacaacttcatttagataacttaaatatatgcttgcttacaattttataatttttgtcagagtatagttaaaagaaaatacagatattatataaactttactagatcattacatatctttaagacactttttaagtaaaaaaggcgggaaaatcccacctgtaagctaaaaagatactgccaattcgtctaagcaagtcttacaaaacgttaaaccaaaaactgctgtatactttaactactaactagtgattgccattatatacttatcaaatgtagtatcaatactgcacttaaaaatcaaaagacaaatctctatttgttaaaatactgtcacttaatgacattggaactagttcttccttttttacttactgcttcttgtcttatacgaagaaaatcttttattcctctttctcttagtttcacctattaaacgctcttgatagtaactagaatactttttaatttcagaatttactctattaaatccatattgttcaataagtgtcttctcattcgaaaataaattagtacctaatccaagtctatcactatcaatatcaatccctaatgaagcaagaatagtaggatacatatcaagaattgaaaattttcgattctttgtattctgtttattaactgcactgtttataaaacaattatacggtgttcgcaaataattcttatctacatttttaaagaacttctccgccatgcttttatgatcaccagtaataacgattgtagtattttcataccacggctgggttttacaccattcaataaaagcatttacttgtttcgattgacaagaaataacattagcatactggtttttatgaatagatttacagtatggacaaacatatccatctggtgtatgtgtatcgattgttaccagttcaaaattaaaaggcttattattagctgctaattccgtaagttcttttctagcaaacttaaacagttttgcatcctcaataccccaaaaaacaaaataatcatctgggatatagccattttttttgaaataattataatcagctattttataattaccatgctgttgataaaaattagatgtacaagcaaaatcaccatcacttcccatcataatctcattaacatagccctgcctttctaatacttctccaatcgtaaaaactccaggtaaaaaaatcgaggtatgatcatacgattttccattaaagggaattaaaagcggtatgccagcttcttgaccaaccatcgaagcaacagtccactgtgttccttctaaagtcatacttccaccaattaaatcattatgtgaaaaattaatattttcttttgcaagtgattgtaattctggcatataacttgtttgttggatcccaccagcttctatatctaaatagctgttttctattgattccaaataaatgtgaatcagatttcttttttgctttggataagttatttttactttattaaaatcaatataatgatcttcatacagattagtctttttaaccatatcaaataaataactaattatttgataattatataatgcataaactattgccattataaccacgatccaaccaatcgttaataaatgatcagttaaaaataaatgtaacgttttaaatggcaaattaaataaaataatttctgcaaccattacaataataaaactagctggcaccgtttttacaaaccaatcagcataaatgccaccatcagttccatctgtaggtgcttttaaatgaaaaatcatttgatttaaagtcttcacagaaaacgttcgattaccccaaataattgaaaaaacagctaataatcccacaaatattaataccgaaccaacaaattctttaattgttatcaatttaaaaatataatttaacatttatatcatctctctatttatactatgccttctaatatacacacattttgttaactaaaaatgtctatataaaatattttagtgccaaattatattatcaacattgtttaaatcattattgcgttataactttttttaattttttttcaaattcacgccgtgaaaacatcacgattgctccacagcctaaacatttaattttaatatcagcacccattcttataatttgccactgatttgattttttacatggatgctgctttttcatttccacaatatcatttaaattataatccatttttctctccgtttcgtttataaaaagcttccagtgtattttgcattaacattgttattgtcatcggtccaatccctcccggaactggtgttatagccattactttatctttaacatcttcaaaatctacatcaccgcacaatttattattttcatcacgattgattcctacatctaaaacaacagcgccatcttttatatattcatgattaaaaaatttaggtttaccaatcgctgcaatcaaaacatcagctcgagaacatactttttttaaatctttagtcttactatgggctattgtcacagttgcatctttttgtaaacataataaagatacaggctttccaacgatattactgcgcccaacaacaacaacttctttacctttcaaatcataattaatctcatctaataacactaacattcctttaggtgtacatggcactaatgactgctgtcctaaaaataatttggcaacattttgaggatgaaaaccatctacatctttatttggatcaatagctttcaacactttttcttctttaatatgctgtggtaaaggtaactgtacaagaatgccatcaacactatcatcattgtttaatcgagcgatttctgctaataactctgcttcactaaacgtatcatcatgttttaacacttctgattcaattccaatataagcacatccccgctctttatttcttacatatgtcttacttgcctgattatcacctattaaaattacaaccaattttggtaatcgtgaataattttctttaatagctgcaacatcttctttcaactgctcttttatttttattgatatttcttttccgctaatgatcatttatatatcccccttaaattattaagtccaattataccaaaatattttctacatgcaacaattagatatctcatcaagatataacttatattcagctaaaatcgtctccaactgctcatatgtatcaattttcgataattcattttttactcttgctgatgactttaatccttttatataccatggtgcatgtcctcgcatttggaacatcgcaaccttttctggttctatttccattaatttttttgcatgagctaaacattgagcgattttttcttgatatgttggttccaaaatttcttcacctgtttttaaagattcaacgacttgttttatcaaccagggattccctagagcagcacgaccaatcatcacggcatccacatttgtttgggctagcattcttttagcatcatcaacagatttaatatcaccattgccaatcacagggatttttactgctgcttttacatcagctataatactccaatcagcctttccttcatacatctgcgatctcgttctaccatggatagcaatagcactagctcccgctttttcaatcaactttgcgatttccacagcattaatatgttctttatcaaaaccacttctaattttaacagttaccggtttagaaacattatcaacaattcctttaacgatttcataaattttatcaggataaagtaataacttacttccagcttcagcctttaatactttattaactgggcatcccatatttatatcaataatatcacaattagaatgctgatcaataaatttagcagctttgaccatagtttctacttcaccaccaaataattgaatactaacgggatgttcaccttcatctacttgaagcatttcaatcgttttagcattgccgtaacaaagagccttatcactaaccatttctgaatacactaatcctgctccaaaatctttaattatttttcgaaaagccatatttgtaattcccgccattggtgccataacaacaggattttcaatctcaacatttcctattttaaacatctactcactcctcatgcagtatcttatcaattatttaaaaaaaaagaaatataaatgtataaaaatttttatcctgttcataatatttacagataacttacacttccccgctattttcctccccgaaatagaagtaagttatcaagttagttatattcctaaatatgttggtaaaccaactaaaaagaaaggcttcccccgcctttcttttttatataatataaactattaaattttttcttttatagcttttaattcattttcatcaaactgatacttagtattacaaaattgacaatttatttcacaaccatgatcttcatcaatcattgcctgtagttcatcttttcctaacgtgattaaagcatctgtcattttttctttcgaacaatcacaataaaaaaataaatcctgcgtttctgtaatttccacatcatcaaataacgattttaatatatcttcaggatcttttttgttattgatcaattcagaaaccggtggacattctttaacgactttttcaatataactaatatcctcttcagttgcttcaggcaataattgaataatataaccaccagatgctaatacctcattagtatcatttactaacacaccaactgatacaaccgatggtgtttgctcacttaccgcaaaataatagctaaaatcatcaccaatctcacctgtttgtaaaggaaccgctcctgtaaatggttccttcagccccatatccttgatgacttgcaaagttccttcatgtccaacagcaacacctactgccaatttaccagtatcattatatgtataatgtacttccggattagcaacaaagcctttaatattaccatctccattagtaatgcacatcattgtcccaattggaccaccgccattgattactacggtcatcttttcagcatttttgttcattctagccatcatcaaagtcgctgacatcattcttcctaatgcagctgatgctgttggccacaaattatgtttttttctggcaacctctactagattagtagttctacatgcaaaaacacggcaatttttactgttaactaaacctctgactaaataatctttcatacaaacctccttaaaaaaacactgcaatcgatgataaaatcatgggaattatcatacataaaacaataaataaaataaatatctttttactatactttttcatttttccacctctaaatatgaaaaaaagcggataccgctttatttcatatcatctaataaatcatcaacatcatcaaacgacaaacctgtatcattggaattatcatcatttggtctatcatctactgttccatcatgacgatctaacatacggccagtattaaacaatgcctcaatttgttcacctgctaatgtttcatactctaataaagcatcagcaataattaccaatttatctttatttgcttcaataatttcttttgctttagcataacattcatcaatgatctttcgaacttgaacatcaatttcataagctatctgtcctgaatgagaattactatgttgagtataatcccgtcctaagaaaacatttccttgttcagaatcatatttaattggtcctaactccgacattcctaattccgtaaccatcattcttgcaattcttgttgcctgttcaatatcattatgagctccagaacttacatcaccaaagaaaatttcttcagcaacacgtccacccataaatcctgcgatattggcttctagctgagttttagtttgaaaatatgtttcttcttttggtgtcatcaagttataaccaccagcttgtccacgaggaatgatcgtaactttctgcactttattagcatcttctaaagttaatcctaaaactgcatgtccagcttcatggtatgcaactaaacgtcgttctttttcactatattttcgagactttttagctggtccacccataacacgatccactgcttcatcaatgtctgccattgaaataactttatgatcttcacgaacagctaataaagccgcttcatttaatacattttccaattctgctccagaaaatcctggcgttctttgcgcaatgttattaaagtcaacatcaggagcaaattttttgttacgcgcatgtacttttaaaatttctgtacgcgcatttttgtccggattagctacttgtatctgtctatcaaaacgacctggtcgtaacaatgccggatccaaaacatcagcacggtttgttgccgctaaaatgataattccttcattaccactaaatccatccatttcaactaataactggttaagtgtttgttcacgttcatcatgtccaccacccataccagtacctctttgacgtccaactgcatcaatttcatcaatgaaaatgatacatggtgccgtttgtttagcttttttaaacatatcacgaacacgtccagctccgactccgacaaacatctctacgaattcagatccagaaattgaataatatggtacactagcttcaccagaaacagctcttgcaagtaatgttttaccagtacctggtggtccaaccaataatactcccttaggaatacgagctcccatctgcgcaaattttttaggattctttaaaaattcaaccagctcttttaactcttctttttcttcatcagcacccgctacatcagaaaatcttgttttttgatttttttctaacttagctctagaatttccaaaatcaaaagccttagcattaccgccaccttgagacatcattctaaaaataaagaacattcccccaagtaataatacataaggtaagatatttgcgacgatacgcataaacattccgcgatcattagcatctacaattgtagtttcaattcctttttcacttaacaatcccgttaatgactgtatctcagcttcagtattaggaatagttgtagtaaattcaacttctgtagattttccatcgactttcttcgtatatttacctgaaacatcaacgactaaagatgaaggaacaatttcaacttccttgattttttcatcctgtactacttccacaaactcactatacttaatttctttaccgttactttgattcataaaagtaaccgctccaccaattaagactagtactaacagccagggaagaattgattttaataatccattcttattgttcataaactctccttacttataacactcttcttttaaaataccaacatatggcaattgacggtacttttcgttaaaatctaatccatagccaacaacaaaagcattaggaattttaaatccgacataatctgctttcatatcaatgacacgaccttcttctttatccaacattgtaacaattttaacactattggctttacgcttcaaaagcatttctttaacgttaaacaatgttttaccagtatcaagaatatcttcaacaattaaaatatttttacccattacatcttcttttagatcttgtttaactacaagcgttttagattcaacaccatcatagctgcttacattcatatagtcaaatgtaacatcactatttaaatgttttgaaagttctgccataaaaggaaccgatccttttaacaagccaactaacaaaacttctttaccttcgtaatctttatcaataatttttcctaactcttcacactttgcacttatttgttcttcagtaattaatatttcttttatgttcttatgcattttattcactcctagccatatatgattataattttaccacatataaattaggttttgaatataaatacccaatattttttgcaagatgtggtacaagaattatatcaccatgacaattttcaacaaccggccaaatttccctttcacttctaggaattttattatcaataaataaacgtgataattttttacttcctccagcactaactatggtatcacctggtttaaacgttcttatcgtaataggaaaatcctcatttgtcaaataaattccttcatttaaatgacctttcttacttaaataaaagtgctcatgtttatcataaactatttgttcgtattttaaacaatagcctatattattttttaatttagaaacacgtatattattatattcttttatgaacctaatattaacaggtaaatccatttcaatatttggtttaccacttttgatctgcttaatgatttctttgatcaaagcatcgctaatcaaaggaggatatactacttctttaactatttcataaataaaactatttaaaagatcataaggaatcaaacggtaatcaataactttatcatcatgatacttatcaagatacggtttcaccctttcgatattttttagatactgctgattatgcaaatcagctttatttaataaatcttttacctgctgttccgtataattttttagtgttacatttcgaacaaaatcacgagtaaaatctgtttgaaaattagtataatcatcacgatagttaacattatgatcatgacagtactctcttaaaacctgtttattaactcctaaaagcggtctaattacagtcaccccaaatacttcactaatattttttatgcctaaatatcctttcgtattatgacgctgcagctgcattacgatattttcaatcacatcatcttgatgatgcgccaaaacaactttatcaacattatatttacaagctatttgacgataaaagtgatatcgcagttttctagcttgtgtttgaaaattttcttttccatattcacatgcatctatttcctttacatagcaaggcagattatgtttatgacaatagttttctactgttttttgatctaaatcgctatcttctcttaaatgataattaacatgacaaacaacgatttgatatccgtgattatacataatatccaaaagtgccattgaatcacagcctccagatacccccactatgtatagttgattcaaatttaataatttctccatcacatcacctcaaatacctttaccattataacaaattatcctttttttaacatatagttttaactattttagtcactaaaaaagcacgtttataacagtttttatttaaagctataaacaaaaacaggaagatttaaaattattgaatttcaataaaaccaattcttcctttttaacgtaccttttatttcaacaattcactttttaccaccttgattactacaatgctgatatcatcgagattattttcttctaaaactcggtccattaacaatgttgccgcctcttgaggatgcatatgattgatcatcttaatatttcttttaataatctgttcaaaattatcaccagttccatcactagacataatgacaatatcattatcttttaataacatttcataactagacatctttaatttagaaacgattcctaccggtaatgaattagttgtgattttttctacagttccattacgaatatgatagctaggattagctccatatttaattaatttcattttcgcattcgctaaatttatatgacataaatctaatgtcgtaaacatatcattatgattttttatttttaataacgcatttatagaatcaatagtatctttcaaactaatcccatttaaaattagtttagatagtacttccaaagttaatttgctttctgttgctgctattttaccctgacccattccatcactcaaagctaaataatgaaggttatcttgatgaaaagcactaaaagaatccccgcaatttaaaggctctaatgcatattgctgtaacccaaactgtaaagaatagtttggctggtgctttaaaaccactgaagtataacctaaataatgcattgcatctttgattgaaataatttctaatgattcgtttaaatagctttcaataattggcactaattcattaattacatcttctttatttatatccattaaacctatttctaaggtataaacatctaaagatatttgatgtttatacaaatatgtaatattaaattgataacctagtaaatgttccttcagctgttgatcaccaaacggtgcctgttctaaagaattactaaaattatcaaacacttcactcaacaaagaaaattcataaaacaaatctctttttaaatgcaaattttcctgatttactctttttatcttttcataactttctttatactcattgattccttttaaaaatttatcaggactaatacaattactatttatatactttagatcctcttcactatatttagatttaaagcccttattaataagtttacctaatctaccaacactgccatcttgataaaaacatagatcccgacttggacaatgcagacagacatcttcatatacataaccaacaaattctccaacattcacattatgattagcttcttgaaaaatattagttaattgtttaaataacgaggcaaatgtattggcccgctgaatcaatttattacgacttgtaatatttttatagtcttcattaagcaatttagggcgccgtttgaaagtaggaataaacaaaaacaaagctgcacttactataataataaaattatgatagtaatagtcatagttaataaaaaatggaagaattaaatgacttaatatatatgttgatgaacaagttaatttatttttagggttgtacataaagaagatactaaaaggaaggatcaacgatagtatttcatctttaagtaagggattaataaacattaaaataattgatatatataaaatcgctggcatcgtactattaatacttaaatagtacgtacttaataataaaaagaagcgtagtaatatcatcatgtataactgattaacttctaccaatgaaacaatagctaacattatcatcacggaaagaattatcatccgcttattcgtatatacttcaattgtattatggataaagacgggaactacttctaagcataataaactatgtattaatgtaaaggataaaataactagtacttctatgtagttataattatatatgtaaagaaagattaaacttactaaagtaactacaaaggccaagtatttacttttaataaatttaaaatgcattagtacctgcattagtattacacttgttaaggagactaacaataacatgtaattttcataagatagataggttattaatactaaagcactcatatatacgatcaaatgtcgatatccacataaaaatgatattactagcatcggaattataaaacaaagcgatgtattatatatttttactaaacctaaaaagagggttaaacaaaaaattgtaatataagtcatcccagcattttttatttttactttacttttttctactgacaaatccatttcattcacctcgtactataaattatatgaatttattataaataatttgtcgttttttaagctcaattaaaataatctagttaaatacgctataatgaagcagatttatttgcaaaaatattgaatttatcaatatttttaaaactgtatatatatgaaaaaatgattaaataaaattttattataaatttatgctcataccaaaaaagctttaataacatgatctattattaaagctttactcattattctggatgatttttataacattcaattaattgtgttaattcattgataattgaattgtaagttagggtattttctttgcttatgggttagaaagatttttctgaaatgcttttggtataaaaatagctcgaaaattattgaccaaaattaaaaaaaaattaattttggtcaataatatgatataatgaacattataaaggagttgttaatgcatgaagttaattgaaagaaaggattatttaaaaactttaataaatgttaagaatacaccagatataaaagtaattacaggagtgaggcgttcagggaaatcaaaattacttctttcatttatggaatggttaaaaaaacaagaacaggattctcatattgtatatattaatttgcaagaaacagaaaatgaacaatttttggaatatcattgtttgcatgattacattttagagcaatatgttgaaggcaaaaataattatctttttatagatgaagttcaattatgcacgcattttgaaaaagcagtaaatagtattcatgctaaagaaatatatgatatatatgtgacaggatcaaatgcttttttattaagtagtgatttagcaactttattcacaggaagaacatttacaatagaggtttttccattttcctttcaagagtttcttgtttattttgatagagatgatacagatcaggcatttaatgattatttaaggattggtggatttgctggatcatatttatatcaccaaatagaacaaaagtatgattatattcaaaaagatgtttatgaaacaatagtaacacgagatattgttcaaaaatataagattagaaacaaaggtctttttgaaaatttaacaaattatcttattgacaacatctccaatttaacatcatctagaaatattacaaactacttaattagtaattatgataaagttagtcacaatacgattatcaattatataaaatatctttgtcatgcgtttgtattttatagagtaaagagatttgatataaaagggaaaaagtatctagctactgaacaaaaatactatcttgttgatcattctattaaatatgcaactcttggaattaagaatcaagatttaggtagaacattagaaaatattgtttatatagaactattaagaagaggatatgaggtctatgttggtaagctttataagaaagaaattgattttgtagcattaaaaagaaatgagcaaatttatattcaagtttcaactttcttagaagatgaaaatacaatcgatagagaagtaacacctttgttgaagataaaagatgcttatcctaaaataattatagcgagaacacatcaagaaatgtatacgattcaaggtataaaggttatagatattgcagattggttaacaagtaataaatatgtttaaaaagcataattaatatatttcgctgaattatttttatcatagttcacactaaaataatttatgatttatatgagttaataaagatagaataaaatagaaaagattgaaatttcttgatgttaaatgtgcttaagatcaaataacttgaatttgataattaaaataatctagttaaatacgctataatgaagcagatttatttgcaaaaatattgaatttatcaatatttttaaaactgtatatatgaaaaaatgattaaataaaattttattataaacttatactcatataaaaaataataaaaaagacatcagttttaatttataagtaataggaaataagtattatttaataaatttcggtgtttaatacataaaaaagggacaaaataaattttgtccacctgggtgatagtgcattttaaatgcctttcatcctttttggtattataatgattttaggagatgactttatgatcgatttatctgttccttctgatacattaggtctttttaattttaagcagtttgttaaaaaagacggtaaaaatacttttaaatatatcttctttgacaattacgactatatcattaatctacatgataaaggcaaactcagggatgtttcttttgataatgttcaaaaaactatcctttgttcttctatccatcttggttatgatctctttgtctgtcctaactgcggcaatgaaactattgttgctcatacctgcagttccagatactgtaccaaatgtggttctaaatccagtcaaagacgcgctgcttatgtcagctctatggcttttaaatccaaacatcgtcatatcgtctttaccatccctgctcagcttcgcttctactttatcaaaaaccgatcactgcttgatggtctttttgtcgttgccagaaatactctggcttcccttttcaacgacagaaaatatcgcagacaaaagcgtcttgaaaaaaagaaaggtatcttctatcataaaaaaagcaataaatctcaatatctttacaaagatacaactgataatgtgatctttggtgccattgcctcattgcacacttttggcagacctcttgactggaatccgcatatccatgttctggtatgcgaagatgcttatgattctaaagataacaaaatcaaaaacttcagttatatggactataaaaaacttcgccagacatggcgttatcaattactcagctatcttgacagacacattggcaacgacaaagaatttcaaagccttaaaagctggttctaccgaaaatacgaggaagggttctatgtctatgctccaaaaatcaaagatgaacagactaaggacgacattgaaaaatgtgttcaatatataacccgttataccagcagaccaataatggctgaaagcaggatagtaaactatgatgatgataagaaaatgattcattggttctatcatcgtcatgaagataataagcgtgtagatgtcacagaatctgtttacagttttcttaacaaggtattgatgcactgtcctgaaaagaacttcaagatggtaagatattttggtttttattcaaataaatcaataaagacctataacaggatggctgaactgttgagccataaacaaaaaagagtagaagaactaaaaaatgacagaagggtgatgatagaaaagagacaaaaagagttacatttcagatataatatgataaaatcatttcaacgggatccattgctttgtgaatgtggagaaacaatggaatataaagaaagctatgaaccatttggtggaaacgataaaaatgacagagaatatcgtgaccgaaagattctcaaagcaaaatacagctatgagcataggaagaaggtaaacaagtgatcaatctgaccgatgaagaactagcagaattattaggggaaccagaggtaatgataccgatgaaatgtaagagatgtggttatgaagaagaagtaccggaatggatactagaagagtttttaggtgaagaaatatattcaggtaaagagaatcaaggatacagctgtcagtgtccaaaatgcaatggaagaatggttaggaaaaaatgatatttctaacacttttttagccacataaaaatatccagccaataaatgtacccttatgattggatatttttattttatacctaaacgaatcgaaattcctattagataaaaaagcgttaaaatttttaacgctttttctactataaatccaatctaaaaccaatatctcccatcaataaagaacgctcatactggctaaaacctaatttttctaacaatctgattgaacgataattatcgttataaacatgtgcaaaaacacttttaaaattataatcatttttcaaaacatctaataatactctgagcgattccgttgcatatccctgatgccaataatcactatcaaaagtatagccaatcgttatagaactagtttctataacttctaaaaaataatcacctatcaggtaattattttcttttaataccacacctaactgataactgcctctagaaccatcaaatggatgttttaaacaatattctattcttttaactgctttattataaggatatcgccaccacgactgataaaacgctacttcttttttattacgatattcacttaaacgttttgcatcagacatagttaattcccttattattaaacgctgagtttcaaaagtttccatcctgccacctcaccgataattatcataacataaattatattattattttagccttttatagcatatttgattgtatttattaaatgttttatcgttatgagaggatgtttaaacagcattcttttgcctgaatatttcattacttcctttatttgatcgcgatattttttttgataacaatgaatagggcaagaggagcagaatgttttttcttctttacgtggacagcaatcgattcttttaaatgcatattcttttaattcacttaaatcctgctgatgacctttttcatatattgaaatcattattgttagtaattctttttctttatctgttgtcattaactttgcctaccttgttcaattttaattattcgatcacaaatttttaatgaggaaggtcggtgacttaccaaaataatcgtttttccttcacgattatcatttaatgattttaaaactaatgcttcatttaaactatctaaattacttgttggctcatctaataaaattaatggtgaatcatgcaaaaaggctcttgctaatgataatctttgtaattgtccgccagataaagattgataaagacttccgatcattgtttcatatccatcttttaaacttataatgaactcatgtaaattggcttttttacaagcttctattacttcttgctgactggcttccattcctaattttatgttattaataatactatcattaaacacataagtatcttgggtaacataactaataagtttagctaaagaatcactttgccatgattttagattatgcccatttatcaaaatatcaccactgctaggatcataaaaacgcattaataattttaataacgtagtctttccactaccactacgaccttctattccaactatctctcctggtttgattaccatattgatcttatctaagatcacttcattttcatacttaaatgataaatcatttatttcaattgttcctaaatccccttgatatccatcactaacctcgacaacttgtggcacttcatccaacagatcaagaaccctatttccactagcaaatgttattactaaattatgtgctagtgatgataaagccaatactggtccaaatgaagacattaaagcaatcgtcccaattaaaacaccattaaaactaattaactgatgaagatacaaataataacttaaaataaacattgccaatgaaaacaagctaacactaatatctccaatcatgcgatactgcccttctaaatcttttaactcttcgttttgattatttagtaattcacttttttgggcaatctcatttaaacgttttttaccacatagaaactgatcaacgatccttaacccatgaacagactccaatacataactagtatatttaccataagtatttcgataatctaatcctttattaccagacactttacctactactagtggaataaatacaccaatgaataaatatgctagcgccgccaacaaggctagtgcaatatgaaaacttcctaaataaacaatcatgataattgaaacaattaaagctatcataactggtgaaattgtatgagcataaaatacctctaatagctcaacatcactagtaatcattgcaactaaattcccatgatcttttccatctagttttgctggtgctaattttctcaattttgcaaaaacaatatctcttatcattgccaataatttaaaagcaataaaatgattacaccactgttcaccataacgtaaaaaaccacgtaaaacaccacaagcaatcagaagataaagtaaattagtaaaggtttctttatttactattttaacaattatttctcctgcaataattgttaaaaatattgcagccaaataaccaattacaccaaggataattgccaacagcatcgttaatatcatcgatttaactagagcaatcaagctaattactaccttcaaattactacgatttttcacttgtattacccccataattttcaatttctttttgtgtattaactaatattcggtattcctcattttctttcattaacatttcatgatttccataacctacaagcttaccatgactaaagacatagttgcacttacaattttcaacacatgctaaacgatgactaatcaaaataacgatcttatctttttgcatttgatcaattactttcatgataatttcttcactttcaatatctatatttgaagtagcttcatcaaaaatatatacttttgtatcatgtagtaatgctctagcaatgctcaaacgttgtttttgaccacctgataaattatttccccgttcttcaatcgcactatctaatcctgctatcccatcaaaataattccacaaattaacttttttcaaaacatctatcatcattgtatcatcactattacaattaccatctaatagatttgaacgtaaagttcctgcaaaaatatatggatcatgctcaaccatagttatttctttcattaaactatgatggttgattttatttacctgtttaccattataagtcaatttaccctgataattatcataataacccattaacaattttgcaatcgtactctttccacttcctgaacttccaacgactccataaacaccaggttgatcgatctttaaacagatatcttttaatacgatcttttcatcatagccaaacgataaattgctaatttcaatttcattaatatcttcaatttctaaattcttatcatctttaatctcgacatctaataatctaaaaatcttttcactcgctgcattaccattcatagcaatatgaaaaaacgatcctaataatctaagcggaataaaaaactcagctgataacataatcatcataaacgcttgtcctaaatcaattgcacctgcttgataactatacaacgaaataacaattcctaaagccgcaccaccataagcaactaaatccataacactaattgaatttaactgcatcactaatactttcattgtaatatttctaaaacgctgtgcttcttcattcatctcaatatgtttatattggtcaccacgatatccttttaatgttgttaaacctttaacattatctaaaaatcgctctgctagattcccatacaatccccaatatttactcaataatctttttgcaaatttttgtactaatacgattgacagcggaatcaatggaacacaaataaaaagcactaatgctgccttaaattctacttgcccaagaataataaacaatgtcactggtgctaacatactgtaaaaaaactgaggtaaatatttaccaaagtatatttctaactgttctacgccttcactcattaactgggtaagtgaagcagtactaatcacttcattatagtgattattcaataataagatttttttataaatatcacatctaagtttcccttttatattttttccggctttaaaagaatatgtggacgccagttttccaaaatacccctttattaaaactaagactacgataattattatcttaactataaaatcatctatcttactataataataaagcttatttatcatatcagccatgatggcaatgataataatttgcgcaataagtcctaaccattgcatcaatacttgtaaatatacatatcttttatcatcttttaaataactaactaatctcttattaatcattacccacttttttaattgtttctattcggaatataaaataataatatttaaatatcactaataaaacaatcgttatccttccataaatattattcatcattaaaaatgcaattaaaagcatagtactagcaaacgataataacatcactttagttcgtaatgtcattgctcttctagtaacaaaatcatttaaatgattttgatacaatttagttccttgaaaccaaattttagcccgcgatgaactctttgtaaaaaagaataaagcagctaaaagaaacggggttgttggtaaaatcggcaacacaactcctatcattccaatcagcataaataccaatcccaaaataaaatacaaatatttcatattatctcctggtatattataaatgactcatttaattagtcatctgcagtataccttttcctttctgttatgaagtgacctttgtcaagtgaaaattacacattcataataaaattatttaattttatcatcaatggcatacaaaagccccaaaatactagatttatcgacagttaaccactctgttatacggagattggctactccaaggttaatggttcgtcaaataagttctaactatctatatacgtgaatcatctataatttatgatattccagatcgcgacttcttttatatcttatttatgccacaaagaaaggaccgtagataactaaacctgcttctccttttttgaggcttttctatgccattgatttcgtgttctttttttctcgatttttgtcctccatttcttattttttctttaaattttcataattgtatagaaaacatctttttacatcttctatattcttcctgtttccattccccatataaatcctgctagttcccttgccactgccatgatagctacattatatggtttccctcttaataccatccttctaaatcttttttgtaatctttctactgccttatctgcatatgctacgatttcatcctcctgtcctttttgtctttttttcaacgcttttgatttctttccaactgttcctcttactaatgcctgtgtacattctaccagtgtctttctaaccatcgcattccccatcttggtgattggtgtattgctgtatttctccgcgctcgaattctctcctggaagcattcccagattcgccataaatgcctttgctgttggaaatcgctgaaaatcactcactgtgacatgtatcttcattgctgataatgtatctattcctttgaaacaggaaattttagaaaccggttccttatattcctcttcttttgaaaactcttctatcctttcatcatatttttcaatacgttcatttaaataatcatagacttttaaatattcatttaatgtttctcttacgattactggcaattctatcgtttcaagccatttgatatgggccactgtccagttgcttttcccctcatatcttaatcctcgtctcaataccaatgcactgatctgctgtttgattctctttcttgactggatgacatcttctcttagacctatatattccttgatttcattgtcatgttctgttggtacatgaacagctttgtatgaatcgtgcataagattagtggcaatattaaaggcatccatcttatcattttttacttttttatttttgactgatccatgcattgttgatggtgctaatataacacatggaatatcatggtatgcaagttcatgatataaggaaaatcctaaacatccagcttcatatcctgttaaaatatccacctcattttcttcactcattctttctttagctgacttaataaatttaagaatattctttacttcagcagcacattttgtctgtgcaataacttctcctgttgatgaattgattccacataaactgtacgtatttttatggacatccatcccaatataaattatacttttcatagtgacctcctattgtcgttatggtatcgactttcataattttgtttttttactaatcttattatgaatcgtaatccactttttgacaacttaggaggtcacttcatattatctatcaatcttatttatccgtgattgatgacggttaagtttttctgtaaaattgaaatatgtgaatgtggatttgtatttctcctcgtggcttgactactttaaaaaggatcttaccacaccttattcctaaacaatgatgagttagatgagtcttgaattcgtattttgtaccaggttttgtggtctaagtgttgtggataccattttcacaattttatcaagaaaggatgttttattatgaatttagttggtattgatattggtaagaataaacacttcttttgtgttatgaataaagatactggtgaacttttagttgatcctgtttctttttctaataataaagaaggctttgattttcttgtcaataaacttaaacctttttctaaagactctattttaatcggtatggaagatactgggcattatcattttgctttattaaagtatctattgaacaaacattttactgtcgccttaatcaatcctaaaatcactgattttacacgtaaaatgcagggtggtattaccaaaaatgataaacttgataccttaatgatttgtgatgttcttgatactcctaagcgtaaaaaacaatatcgtatcacgaaagtcaacagctttgacctttatgaacaaaagcaattgacaagacatcatcacaacctaaaggaagaactcaacgtttattcaaatcgtcttcaaaaatgcatcgatattgtatttcctgaattcaatagcttatttaaatctaaatatggtactgtttacataaatcttcttagaacatttggtggttgtgctgaaacaatcgctaatactgacataagaacgattcgtaaatgctttgaaatcaaaggcagaggaaaacgtatttctttaacacctgaaaaactaaaaggatgtgctaaacaatccattggtatttcttctgctgctgaagttatccaaatcaagcatttagtcaatcaaatagaactcatcaataaacaaatcgctgaaatagataaaaaaatagaagagttctccgtgaaaaacaactctcctatcctatccataccaggaatttctcatttctctggtacttctattttagccgaattaggagatataagcaactataaaaagccttctcaaattataaaatttgcaggagtcgctccaatgcattatgaatccagccaatttactgcacagcacactgctatcactaagaaagggtctaaatatctaaggaagaccttatatcagattatattgcctgtgattaatcataatcctgtatttaaacaatattatgaattaaagatttctcaaggtaagggtcatcgttgtgctcaaggtcattgtgtaagaaaattacttagaatcatatatcacttattaagtactaatcaaaaatttgatccagcacttttaagataactatacaaattttaaaaatgcctttttaaaggttgtttttgtcatgctcaaaaatgacaaatcactattcacttatcaaagatctttaccagttaacatacaaaatcaaaaatttcatattttcaaactttttcatcaaaaactcttgatttttatatagttagcttttttattataaatatcagatttactttaacattatcaaaagatattttcaatataaatgttagtcttttttaacatccggtcataaaaaaaggattcatgatagattcacgaaccctttaaatattaattgaattttctttttacaaatgccaatccacaaacacttaataatgctgctgttgcatacaaactagttaaaacattatcaccagttggaacagctttttcaggactatctggactaggtgcaactggtgttgctggttgttctgcatcaacattataattagctgcccattccataattgatgtcccactagcatcttttggattattatttaatgtaaaaatccatgtccagtgatcattataatgaactaatgtaggaataccatccatatcataatcttcttcaagatttattttattggcaccatcaacatttactgtatcatataaagttaatttatatttattatctttagtttcataagttgtgaaatcagaattgatattttgcaaatatcttatttctgtagtttcttgaccttcagttaaaatcttaaacattctctttgaacattcatctgttgcaacacttgaatctgttaccccttgaactaaccaaattgcagtatcagattttgttaatgaagctaattcttcatcagttggtgtttgtccaccacgaatagttgctacatctaaagctgggcagttgatcatagcagctttaaataaatcaggatatgcaatcaacattcttgtagtcatataaccaccagctgaacaacctgatacatatactttttcaggatcaatatttttagctttaattaaatcattgatttcattatatgctatttctaataaaccatctctttgagcataataccaagtatcaggtgcctggaatgacataacatgagccccaccaaaaatttcttgtgcttcatcactagcccaagctacagttcctctgtttgcaagcatttgagctacattattaccagaatttaaaagatctccttcaccatttccatggaaccaaacaataagtgaatctgcatccccagcatcataatattgatagttaataccattttctactattacagattcaaatttagctgtttcatcattagttacagtattatctgtagtatattttgcaatataatcattatcgatttctcgaccatctgcagcagtcaatgttacacctttattttgaacgatcgtatactctaattcaccaggataatttcttgcatatcctttttctgcatcacttatgtatgtcaatgttgatccatacccatcattttcatcaaaataaacattaacatattgaccatccgtctctacttttacaattttacgttcaccatcgtattgtacttttcctttataatcctcatcttcaattttaatagtagattttgcagtaactgtaaaagtatcaacatctacatttgaaaccctatttccagctccaaaatcaattgtcattttgtttactacttcaccagcatcggtaactcttgcagacagactacagttataagtagtatctacagtttgtgctaataccggtgcactaaaagcagttactgctaatgccatactggcagcagctgcaaaaatttttctaaattttttcatttccttatacctcctacacatattatagcattgcttacttttagctgtatttatatatttatacatttagtcccaaaaattgatactatatttataaaatttaatcttgaaaaaataatgaatttatgttatagaatctaaaattttaatatgaaatattgatttaaaaatgttataatataggtatatcaacgtgtagtttgcagaacgtaaatccggttgcaactacacttttttaattatagaaggaggataataaatgtataaaattggtgaaaatgttttatatggtagtgaaggtgtatgcaaaataactgatattgtttcaagagtaatcaataatcaagaaaaaaagttttatctcttgacttcttccagcaataaaatgaatattcttgttcctttagataatgaactttctttagcaaaaatgcgtaaaattttatcaaaagaagaaatatacaaacttattgaagctatgcctgataatgaaactatttggataaatgataaaaatgttcgcaaaaaaaagtataatgaaattattgtaaaaggtgaccatgaacaaatcgtcaaactgatcaaaactttgtatttaaacaaacaagagcaaataaaaaaaggaaaaaaatttcatgttcaagatatgtatctacttgatgcagctgaaaaaatgctctatgaagaattttcttatactttagacattcaacctgacgaggtacttccttttattttaaaaaacattaaattaaacgaaaaaggtaacaacaatgtataatatcaatgattacgtaattcatcaaaataatcatatttatcaaatcattgcaataaataatcaactcaccttaaagtctcctttaaacaacaactctattttagctgattctaaggatattattcgaaaagtcacaactaaaaaggaacttgaagaaattattgagcgaattccctatatccgcactttagaaataacaagcgagcgctttcgtcaagaactatatagaaaaacatttgatagctacttagaaatagaatggatcaaactaataaaaacaatttatttgcgccatcgttttcataaagctcagtcatacgaattagattatttaaaacaaaccaaaactctttttcatgaagaagttgcaattgtattaaatatgccaattgataaagtagatgattatattaaaaataaggttatggaattttaaatttattactaatatttttatgattagtaataaacaactaaaagtaagagatttcaaataatgaatcacttttatcaaataaacaagtaatagtcaaaattactttatatgaagttgtcgaatagacagcttcatttttatttaaaaatcatttttcgttttatatcaaaaacaatatacaaatatctttattatcattgtaaagataaataaaaatagtatctataaataagatatctatagatactattatgacttatacattagtcttcttttcttttataactcgttacaattgtagccatacttaataatccaagtcctgcaaatacaccaattaaactgtcatctccagtcttgatacttactgttgtatctccggcttttactgctggatcaatattttcttcattagctactaatcccgctaatccctttgctaaaacatcttttgcgttatcaacttgctcttgtgttgcttctggatcttctaatactaccttagcttcgtttaaagcatctgcgactaccgcccatgttttagcactgtagtttgcagcgtttaagttatttgccttattgatcaactcttgtaataagtctttatttggttttaatcttaagttcaagaacgcttttactaattctgtaaaggcttcatctacttcaccttgcattgcattttcatctgctaatacatcatttgctttatctaatgctggtaacatattagaccatgatgattcaatgtatttactttcatctaatccattgatttgatctacttgtttttgtaatgctgttttgtcacctttgtagaattgtaacatatgcattacatttgctagtcgagcaaaagcactatctacttcactttgagtggcactagtttttgcatatacttcttttgcgtttgttaaagcttcattgaattcagttactacaactggtacgacattttctaagtcggctttttctgccatttcaatggcaatttgtaaagctgttttatcgctttcgattacttgttcaactaaagcatcttttgcagcttgtaacaatactactgcattatttacttcttcttgagttacctcttcactatctaatatattcttagtttttgtcattgtctcaataaatgatacccaagtttgggatgtatagttttcttctttaagagctaaacattcatcatataatgtctgtaattcatctttattgatttcaactttgtcaaagcgcatataatcaagattaaagtttcctggattaatatcgccttctgagcgaatcatgatggtatttttaccagcttttaatgctatattactgattgcaacttcattccatacaccatttttctgactatcaccccatgttggtgttacttcaatttcaaaatcagctcttttttcatcattaatatataatgctcccgttcgtggtgtgtcatcataaactgctgatccttttttaccacatccagcatttaatactaaattataaatgccagattcttttaaatcaactgtgaattgtacatagtttccgacatttttccatcctgccaaataaccagttcctgaatatcctttccattctgtatcaattcttaattgattttttgatgaatcagttactccttcaccattttctaactcgaaaatatcaccaggattaatttctggtaatttaggctcaaaatagaaccagtcaacatcacactgaaagtcagtatcatctataccattaaattctaaaaagatattactttcaatagcatctgtatctttacacattacttctaatgttgtccactgatcatcttttggtatatctaaagtggttagaatcttatcacctataccattttcatatactgtaatcttcccaccagtactactctttaatctaattacaataccacctttgtcttcacctttaacttcattaaactctagccaagaaccacttgtatttgttgacatgattttgcgattacctgctgcatcatcgtcaataattgtaaatccttttgaagcagtagcattttctgcctctatttgactaaatgcgtcaatagaacgatcaattcgattaaatgtcaatgaatccaagttataatttcctggatttgtattcccttcggcgacaaatttaaatgtatttacaccagcttctaaaggaacattttcaattgtatatttgacccatacaccttgttttactccattaaccgtttcaccccacttatcagttatcgcaaattccatatcctgaagcttttgaccatttagatacattgttccctgtcgtggactattatcatatcttgaatcatttttaattccattattaacatttaatactaagttataatctccagctctttgaatatcaacactaaattctactgcatctccaactgttttaaaccctttagcaaatcctgttccggtatatcctttccattctgtatcaacagagacactaccatacattttagcttcttctaattcaaaaacatcaccatcattgattttttgtggtggaacactttgttcttcttcacccaattctacttctttttcaacaacatcaagtagtttgatattaatttctgttcctgtatctttagtttttacataaacaagatcattttctgtatctaaccaatatgcttgtttagcattgttataatcatctaaagttttcacttcagtaatctctaaaccatcaatataaacaccagctaatgcttcaatatggttaaatttcaaattgtaattacgatctactggcgtatatacatcagcattcccatttactctttcattaattttaaaattaatttctgttccatttactgcacaatcaaatttagttgtagtataagcatttttagtgatatattcacgtgtctgcccatcatcttcatataatgtaaatgtgctttcaccttttggataaatatctaaagttaatggatccaatggtttttcatcagcataatttacatcaggccccattggtacaattgcccctgcttttataaatactggtatttcatctaatggagctgctactctaatagtttttccattttcgccaccttcatagcgctcaccactataataattataccatgttgtttttggtggtaaccaaactgataccactgtatctttagtatctgcagcaggtgctactaaaaaataatccccataataatattgttcatttaaatcccaagcatcaggattatattgactatcatcttccaaaagcattgctctcatgattggaacaccttgactatatccttgccaagcaagtgaatatgtatatgggtataaagaataacggatttttaaattatctcttaatgtttcttgtgctgtttcgttataatcccaaggttcacgaccatcatgaccatgagtccgcataatcccattccaagctccaaattctccaacccagcgagtatacaattcatcagttggtcttttcatgaatccgccaagatcatgtgatgttgcccaataaccaattagcccagtatcaatactataaccgatttgattaattaactcttgtgaagttggattaatatcacctgaccaggcagttgcataatgctgccctgcataacttccacgagttataaacatcggacgactttgatctgtgtattcctgccaagcctcatatgccccctttgatgaaaaagttggtgctgtattacttcccaaaacatcaaattcatcaggccagaaccaatctccataaccagttgtaatgacactgtccatatatgattttacccatattttttcattttctggtttatataactctgctccaccagaagcttctggagttcctgcgttgttatgaagacctactctaaaacctaattcatcagcttcttcaaacatagctgcaatatcagggaatttagtagtatcattactccacatttgttttccccacttttcaccagcaccgctttggtttccaccgttatcagcaacatcgccacgccagccaaaatcgaaaacataacagtcacttgggtaatcttcatctcttaaacgatgaatccattccaaaaattcttcttgagtggcattatcatttccatatttagacaacataaatccatgggcccatttgccatacatttccattcttccagtaatttctgcatattcattcaatattgtcttaaaatcaggaccatacataaaataataatctaaataattcttagtctgaaatccaccaccatgtttaaagaatgtcgtttctttttctatcgtgtttaaaaacatcccatatcccacagtactcataaaaaacggtgctactactctaccgtgagacattgaaaattctgaaaaatcttgatcatatcgatttagattacttcttcgaccatgatcacctgagccaaatccaaaaataccaccagtatttatttgaccttctactttttttactccccgaacacctgaatcattccaatacattccttgatcatcagcatctttactaattaaatttccttctaaatcatacattccaatccgaaatggatctttttgtactctgacttcaattgcttctgtcaagatttgaatataatcaccttgatcattaaccgttttatcaactaatggccagtcatttttttgaaccatataatattgtggatcttctggccgatatccttcccctccatcaagtgataattgtacccttattgttctagcagtacataattcaatttttacttgtgcattttcatcgttgaaaataagcacatttccatcttcttcattattatgatctgtataactgccgattacgctttccgtagcagctaatactttggtatcaactcttaaacctaaaagtgttgaaatacaaatcattactactaataataaacatgtactttttttgattttcctaatcatttcccttctcctttcacgttgatatcatgtcacttctttaccccgctaaaatacaacatataccaatctgattatatgatatcaattgctgaatgcacttacaatcgctaatttttgtaattattttttccgatatttacatccttgatgaaaaaaatacttttttaacaaagaattatatagtcataatattctaaaaataaaaagtgtgtaataggatgaactaccatagttcattccttatttacacactttatctttgtattttttattatttcaaattatgataaataaataacattctatccttaccattaatatccttaataatttcataacaatcatcaggaaaatatttttgtaatgcttcttccattagttcccgttgatcaaaacccatttcaaatgcaagcagtgcacgatcattcaataaacttctcacgcctttgaagatcttacgataaaaatacaaaccatcagcaccaccaaaaagagcaacatgtggttcattatctttaacgatagcttctatctcctgttcttgaggaatataaggaggattagaaacaaaaatatctacctttatattacgatcaatcaatggttccagcatatcaccgaccataaattcaacatctgcatttaaatttttagcattttctttagccacattaacagcatttatagaaatatctgttgcatatacctttaatcttggctcttctaacgctaaacttgtagcaatagccccactaccagtaccaacatcacataaattaattgtctgataatctgcaaaataatcatctatacgatataaaatattttcaaccaattcttccgtttcataacgaggaatcaaaacatcttcatttactttaaaatcacgaccaaaaaacgtttccactcccttgatatattgaattggtctaccattataatactcttccattcccgctaaaaattgatcttttaatgtatcatcaacctcttgatcatacattaagtataattcatgtggctcttttttagctaaatgataaaacaatacttttgcaacattaacatctttattatcatcatctaaacgactttctgcttgtttaattagttcctttacagttgccattaatgctgtccttccatttttaaacgttgatcttcattgattaaagctgtaatgatatcatctaatttaccttcaataattcgatctaactgttgaatcgtcaacccaatacgatgatcagttacccgattttgagggtaattataagttctaattttctctgctcgatcacctgaaccaactttactttttctttcatttccaacttgttcatcttgctgttgttgataataatcatagattctagcaattaaagctctcattgctttatctttgttatcatgttgtgaacggccatcttgactggctgcaacgattcccgttggaaggtgagtaattcttactgctgaatctgtcttattgatatgttgacccccagccccactagcacgataagtatcaattcttaaatcacttttattaatttcaacatctacttcttcaacttccggcataactaaaacagtagcagtagaagtatgcacgcggccttgagtttctgtttttggaacacgttgaacacgatgagaaccagattcaaattttaattttccatatacaccttcgcctttaaccataaaagaaatcaatgaataaccaccagcttcagcatcaactgcttccattacttcaattttccaaccttgagattctgcatattttacatacatccgatacaaatcaccagcaaagatgtttccttcatcaccaccagcagcaccacgaatttccataattacatctttattatcatttggatcttttggaattaattcgatttctaactttttaatgatttctggtaatttttcttccaattcagctaattccattttagccatttctttgatctcaggatctgattcttttgttaattctttagcatcttctatcccggcttcaatttctttatactcttgatataaatcatatgctgtttgtaatgacgcctgttctttagtaacttcggtcatttttttaatatcactgccaatatccggatccatcagcatatgtcctaattcttcatacctgttttccattgtttttaaacgatctaacatactttcattcatgatttatacctccaaacctaccatattatataataaacatagaaaataagcaaaatatattttatttgttttaatcttacttatagtataattttagtaaaaaaaattatactatattaattatagttcacattgagttcacctaatcattttattatataggtgtagtaagaaaactacccctccctttaatcatagaaaacgaagacaagttacctaaaagtaacttgtctttattttatctaataggaatttcgattcgtttaggtataaaataaaaatatccaatcataagggtacatttattggctggatatttttatgtggctaaaaaagtgttagaaatatcattttttcctaaccattcttccattgcattttggacactgacagctgtatccttgattctctttacctgaatatatttcttcacctaaaaactcttctagtatccattccggtacttcttcttcataaccacatctcttacatttcatcggtatcattacctctggttcccctaataattctgctagttcttcatcggtcagattgatcacttgtttaccttcttcctatgctcatagctgtattttgctttgagaatctttcggtcacgatattctctgtcatttttatcgtttccaccaaatggttcatagctttctttatattccattgtttctccacattcacaaagcaatggatcccgttgaaatgattttatcatattatatctgaaatgtaactctttttgtctcttttctatcatcacccttctgtcattttttagttcttctactcttttttgtttatggctcaacagttcagccatcctgttataggtctttattgatttatttgaataaaaaccaaaatatcttaccatcttgaagttcttttcaggacagtgcatcaataccttgttaagaaaactgtaaacagattctgtgacatctacacgcttattatcttcatgacgatgatagaaccaatgaatcattttcttatcatcatcatagtttactatcctgctttcagccattattggtctgctggtataacgggttatatattgaacacatttttcaatgtcgtccttagtctgttcatctttgatttttggagcatagacatagaacccttcctcgtattttcggtagaaccagcttttaaggctttgaaattctttgtcgttgccaatgtgtctgtcaagatagctgagtaattgataacgccatgtctggcgaagttttttatagtccatataactgaagtttttgattttgtcatctttagaatcataagcatcttcgcataccagaacatggatatgcggattccagtcaagaggtctgccaaaagtgtgcaatgaggcaatggcaccaaagatcacattatcagttgtatctttgtaaagatattgagatttattgctttttttatgatagaagatacctttctttttttcaagacgcttttgtctgcgatattttctgtcgttgaaaagggaagccagagtatttctggcaacgacaaaaagaccatcaagcagtgatcggtttttgataaagtagaagcgaagctgagcagggatggtaaagacgatatgacgatgtttggatttaaaagccatagagctgacataagcagcgcgtctttgactggatttagaaccacatttggtacagtatctggaactgcaggtatgagcaacaatagtttcattgccgcagttaggacagacaaagagatcataaccaagatggatagaagaacaaaggatagttttttgaacattatcaaaagaaacatccctgagtttgcctttatcatgtagattaatgatatagtcgtaattgtcaaagaagatatatttaaaagtatttttaccgtcttttttaacaaactgcttaaaattaaaaagacctaatgtatcagaaggaacagataaatcgatcataaagtcatctcctaaaatcattataataccaaaaaggatgaaaggcatttaaaatgcactatcacccaggtggacaaaatttattttgtcccttttttatccataaatttattctttagtaaaaatgggtgttatgatcaattcataacatccatttttttaaatattttcttttttctttttactatagattaaacctaatacacttaatccagctatactcattaacattcctagtgatacatcatctcctgtttttacacttgctgttgtatctcctagatttatagaagttatatctgaattagctactaatcccgccattgcttttgttagagcatctttggcattgtccacctctgtttgacttgcttctggatcattgaatactgctttggcatcattcaatgtatcattcatcactttccatgatgctgctgtataatttgcttcacttaatccattagcttgattgattaaactgcttaataagtctttatttggttttagtcttaagttcaagaacgcttttactaattcactatatacttcatcaacttcatcctgcatcgcattaacatctgctaatacatcatttgctttatctaatgctggtaacattgcatgccatgatgattcaatatatttgctttcatctaaactgttgatttgatctacttgtttttgtaatactgttttgtcaccttgatagaattccaacatctgcattgcctttgctagtcgatcaaaggcactatctacttcactttgagtggcattagtttttgcatatacttcttttgcatttgttaaagcttcattgaattcggttactactgctggtacgacattttctaagtcggcttttttagccatttcaatggcaatttgtaaagctaatttatctgtttcaattgcttttttaactaacgcatctttggcacttattaaagctgtcttagcattatctatttgttcttgggttacattttcattatctaaaacagctttaacatcaaaaattgcttctttaaatttaatccagctttctactgtataatcatcctcttgaagtgctatacattcatcatataatacttgtaattcggttttatcaacagtacgttctagtaatcttattgcatcagttaattgttcatacgctacatcaacctggctttgattaacatcatagcttaaattgacattaatagcattgattaaattatcgtaaaaataagttgctattgcttcagaaacattatctaaggctccactttgttctaataactgagccttttcaattaagtcattcaaaatagttttttgaacaatctgctgaccagtaaaataagcttcaaaaatctctgcactatcctgccacgacatttcaatctcaattacattataaccatttaaatttattacattatatacttctttatagtctcctaaatcaatccattcttcaattaattcagtatcctttttttgaactttcgctttaatattaacaatggaatcactatcctttaaaaagataaattgttctggatttggatggttaaaagttttaaaattaatctttccagcttggttatttacacttgtaaaaatatcaccgtctgaaatattatctacattactaatatctccaccaacaaagtttacattctcatctaataaacgattaacatatatttctttaatttgaatccaatttccattagacatataaaaacgtaaatatctagcttgttcaccattaaactgaattttttgatattcggttccaaccttatcaaaactataaattgttttccattgctcaccatctaacgaagcatcaactcttccatataatacattatcactagaatataatacttccatatcatccaatgatgtaataccctgtaaatctaaatcaatatatctagttaattctgaattaccattatcaccacgttttaaccataaagtagtgttttcattaccatcaactaaattattggcactaccactccatacgtccccactattagttgtaagacttgcttttaaagctaaccttccagctaaacggatttcaatattactaattgtaagagaatgatcagtatgattagaaatttctatatatttagcagttatattctttaattcattaattggttgttccttccaaattaaaccatcatctgatacttttacagttacctctgaattatccaaactaatcatagttaaattctttaattgatcaaatgttgctctgatatatttttgtgattgtaaaacaatatttgtatcactatcgattttaataatattctcatctttaattacatttaaatctgatagataattatcattagtacataaagtaacaactttatcttgattgatcaagatttcatttaaaataacattagaattattagcccctgttacactatcttcatgttcagctatagcacgataacgaagataacgagctgttatatctgtttcagcttctactgtagctgaattaaaatcatttattttaatccaattttgattatccaatgaatattctagcgtaccttccttataataagcaggtttattgtcttttttttcttgcataataatcttgatttttgaaatattcatttctttgcctagatttacaccaaaataatctccattaatatattgtcctatttcaacgcttgtatttatttgaccatcaaatgcttttgaataatctttttttgcagtaccaaagcctttcatagtagaaggaatatttaattttgtatataaatcttcttccattttggttaataaatcttcaacaaacggataaagaactttttgcgccgcctttttaccaccatgaccttgatttgatttatccaattttacctttccggttgttacaatatccattgccgctttaattgaatcgctattattttgatcaacctggtcatatgttgttaaagaatcaacaacataaattccagcatcagcaatatcataaacaacatccatccattgatttatttcgctactaatattattagtgcctttataggctttcaatgttgtaatagcatccttgagttccttgaaatgatcttttactacttcaacctctttgccataatcttcacctttagcatatttttcccttaaagcatttaaatcttcctgcatataaactgattcatcggtttgagcgaatgacatcggcgcagctgcacagttctgcgcaaaaatttcaaaagccttagatgcatcttcatcatctgtaataatatgttttaaagcacttttccaactgtcattactattataagcattactgttccaagtataatcggccacactatataaactaactttacttgcttgagcctgattcattggatttgatgttagtccactcatattttcaagattattttctaatccttcagatgggcctagatgcattaaatgagatcttcccaaatcattaactggccagttccaccaaatatatactggtctttgaatcagattagttatccaatcgattgaagcttgcgtaatttccgaaacaacatgatctcctgtccacataacttgaattcgtttatcaaaattactaatattgcgaaggtaactctcacttgccccatcttttcgataatactgtgggcagaaaataagtggtttacaatcaccttttttatcaacatattcggtttgaattttattcatatactcaaccaggcgtgtattattagttgaagaatcatcaaaaaatattgcaaattgacgaacaccaatatcatataactgatcaaatttgatttctaaagatgcaatatcagcatcagataaatctgtatgtcccccaacgtgagcagcccaaacaaattcaacacccgatttctttccagcatcaactaattcttttaattcagctaatttattatctggatataaatctcgccactgtccataatggtatgaatcattcttaggaccatatatataagtattcatcttataacgtcccccaaattcaattaaactcattctattttcatgagaccaagccccataaaaaccttcaatgaaaccgcgatattcaacatctggagcatcttcaattgttaaatcttgaactactccttcaccttgttcaattaaactttctagtgtataagaaccatacttaactccagcatcatcattaccaagaattgcaatcgtattcttttcttcatcaacatttaaaacataaccttcatctttatcagtagaaatttcagtattatattcaatgccataatagtattcatcaacaatcccgtaatcatccttgaccccaactaaaatatttgtcttattttcatcaatattattacctaaaacatacttgatttctaatttattcaaaacatcagtataattatcttttgtaatctcacttacagtatcttcaaaaataagattaacttcctgacttatttccaattccccttcatcatacaagatactttgaggagttggataaagttcatactcttttccaatcttactaacaactataatatcaaaagttttttctttagtaacatcaaaccgagtaactatagctgttaatttaactttttgttcattttctgttctaataattttagctttaccattttcatcaattgtaactgctttattatcagatttccagttaaccgtaacaccatattcagtatctaaaactggtaaattaaaatctttgttaaccctttctttaactgttaatttgtttaaatattcatttacatatgcttcatcagaccattctggtccataaacttcaaattcataaagtgaatatcctgtattattatcattatttttttctcttcttctttgtatcccttgcattctgacatatcgagctgtaactgcttcacttaattctatcacgtttacagctgttttatcaggaaacagagcctcttcgtcaagataaaaaccgttatcaataacttcacccacatcctgccaatcatttaaatcattagatacctgcattttaaatttgtttggacgtgattcccaactcaatacaaacttatttacttcttttgctgtccctaaatcaacataaatccaagatccatcaatattagatgcatctttccccgctaatgtcgcccaacgattgctacttacattgacaattccatcaaacgcttcactttctggggttccagaatcctgaatgcttgaagcaacaccatttttatttaacgctaaattagtactagcatcaccaatttgtgaatcaatcgctaatacattaactgacgcaaatgtattcaaagtgattgctaaacataaaaaaatctttgataatttcatccgttttccctccaattttacttggtagtgtcaaaaatcaatataaatgacacaaacccactacctttcatttgttaataagtagtaaaaatgattactaattatatttcttctgctctaaaatataatattaattcttaaattaaaaataattgaaaataaattatccctttaccatttatccaaaatcaaaaaagattttagttattatctgcttgaaattctcttctgttattctagttttaaacttctttcttcttaattactaaatatccaaatattataaatacacctagacaactaaacttatagtatcatcaatatttatacttgttatcatattactaaaattttcaaacacttcatttacatctaaatcaattaaattttctatagctactaattctgcaatagatagtaatgtttttaaatatcgcataaattaaatagtaaaatatctcttaattaaaaaatatattactataaaataacatttatccattattcaaagatagtttaaaagtgagaaacccttttatagcaaaggtcttctcactttttcctttaactatcaaaaacattgcattccttgacattcaaaacctaaataagtattataccccttccctcaaggaatacttttcaaatagatatatttaatattaattagttcttttctttttactatagattaaacctaatacacttaatccagctatactcattaacattcctagtgatacatcatctcctgtttttacacttgctgttgtatctccggcttttactggtgttacaactggatttgctgttaatcctgccattgcttttgttagagcatctttggcattgtccacctctgcttgacttgcttctggatcattgaatactgctttggcctcattcaatgtatcattcatcactttccatgatgctgctgtgtaatttgcttcacttaatccattagcttgattgattaaactgcttaataagtctttatttggttttagtcttaagttcaagaacgcttttactaattcactatatacttcatcaacttcatcctgcatcgcattaacatctgctaatacatcatttgctttatctaatgctggtaacattgcatgccatgatgattcaatatacttgctttcatctaaacctttgatttgatctacttgtttttgtaatgctgttttgtcaccttgatagaattccaacatctgcattgcatttgctagtcgagcaaaagcactatctacttcactttgagtggcattagtttttgcatatacttcttttgcatttgttaaagcttcattgaattcagttactacagctggtacgacattttctaaatcagctttttcagccatttcaatggcaatttgtaaggcctgcttatcaattatagttgtttcttgttgttcataaacttcaacctcatacaaagaatatccataattccattgccagccatcgttgcttgggacagcttttgtacagtatatacgaatatatctaccggttactccagctagatctaaaatatcttctttgccatctccatcaacaacttttaatacatctgtgaagttttcaccatcttgtgaaacctgaacaatatattcttgagcataagcagattcccaataaagtttaactgttcctaaatcataagaatcttttagatcgatacataaccattctgttttatcaaatggatcattaacactactattataattagaagaccagcgtgtatcttgatttccatcatttgcaaacacagcatctaatgaactgtttttagcacttgaaacagttactggtttatttaatgctagattttcagattctggcttaggatcaatttcactattttcaaatccgcctaattgggcaatttcttcatttgtaagtacatgatcatatagttgaaaattatctaaacttcctactaaattttgaccgattttttctaatggcatattcatagatggtgaatctacccaccatgttccattaaaaccttctggttttgtaggtccttgtaaagtagaaaccagagttccattaacatataaagtgttaggctgattccacttagcgtactcacctccagttggtttagattcatcagaagtaaaagcaattcgataaggttgtcctttcttaaatgtatagttatgttcaaaattaaagttttcacgtgaataagttaaacaataagtaccatcactttgttctttcattacaatagaacgtttttcttgccctcttgaaattccatccttttctacacatccttgatcaggcatcgtttcttcaaaaagaataatatctcccgtttgtttttcatcgatcgttaaatcaaatactgctgtatatggccattttaaagctttatgttgagcttcaatataatcgttaccatcaaatgtaagttgttttccattaggaccatcagtcaattttgctccagtaactgtagcattataaccattacctgaaacatctattaactcatttccatctatttcttccatattaaagttgtaaacaatttcactttgagaatcaatatctttatataggttatttaatcctggtcctacttcgatcgtatcaactttttctttaaattcttcaaaagtttcatcctcacgaccataccaatacgtttgtgctaaatatggatattgagaacgttgccttgcaaaaatatcatttacagtataaccagcaaacattccccggtcattccaaagcagcattgttccaccaacaatattcggatgtccttcagggaaaatagttccatttccataccatccgaccatattgccggcacttaattcattataaagacgttgttcattagcataatcataaaaaccgatctgggctccaggtacaatataccaacggtgatctccatttacaattttataaccttgatccattagttgtttcaaaccacctgatacttcttcccatttccaatagtcaataataatatcatccattggatatgcctcttttggataattttcatttgcaagagaagcattagagtcccatccaaatgcagttttatgatatgtatttacaactttatcatacatatgaacggcataagcacggaggtcatcctgattaccaaaatattcatccatcccaatattaaaggcatctgtaataataactggatcatcaccacctaaatactcttccaaaatttcatccattaaatttaaaacccgttcgcgagctccaccttcttcacttaaattgaagtgagtttcatctaatcctaaattcttatacttatctgaggcatcttcataattgccaagttcgataaaacgacgagcatgagctggtccatcaatttcggtaattacgcgaattccataatcagctgcgagtctttgaaaattacgatactcttctttagtataatatccatccgtacttgttaaatgtggaatatctgattctaaacggaatgcagaataatcattaaaagtatcttcactaatatgcgattgaaaatctgtaagttttaaccatgatgcatatttaattacatcttctaaataccacattgggaaatatttacgtccaatatctaacataaatttacggatttcatagttaggataatctattgctttaccataagcgatagtactatttcctgatgtgatcattccttgaagtaaacttctagttccaaagaaaataccacgataggcaattccgcgaattgtcacataatcattaatttctagttcatatccctgttcacctagcttttcatctccattttcaaaagtcaaaacaagatcaccagcttttggtgtatcagaaacaatttttaaatctaatccgaataattccttaatatcactctgtgtaatttcagcagctctaattaattcatccatttctttagtagaaataacaatacgactatttttatcaaatgaaaatgttcctttatcagctccacaccactcctgcatagttggaacaactttaggcatttcattagttcctgtagtttttttacctttaacagttatccatttatttttaataaatgttccttcatcataagctatatcttctctattctcttgaataatataagtaatttgaactttcttatctactaatggctgtcgtaagactttaccttcatcattaataaccaaatcattttcactacagaaaagtttagaaatcaacttaccatcttctgattcaaaagttggtaattccttcacttcattaggatcaatcactaaatctcttaaataatttttagttttttcaaccatctcatcataaataatttctgattgatcacgatttaataaatattcatcttcaatttcttctggagacagcacggtacgatacactttaacatcatcaattaatgaatcgattcgatatcccccattgccatcagcaccaatattaaagggattagaaacagtagcatctatattagcagtagaagcaattgatgtagaagcaatcatatttccatcaacatataacatactactattatcacgatctaatacagcagcaatataatgccatttcccatcataaaccttgcttgctgtacctgaaacaatattttcttgttgactatgaccattagctgcatatgtagtatagaattgcccttgtccctgaacaactgccatgcccggattggctccactatcccaatttttatcacctaatacagctgaccacgttcctggattcgttgccttataccaaaatccaaccgaaaaatcatctgtacctaaatttaagtcattagttgttttagcaacagatacatatccctgttgagttgataatgcattacctaggttttctaatcctggaacgaatgatacagttcctttttcaactccattattacctcgtccagtcttatcactcattggatcatcgccatcaaaatcccaccaggctactgcttcactgcgtttaacaggttttctttgcaaagctgaaattgcatcatttaaagtatcaactatcttatttacagctatttgactatctttattagctgtcttagctgcattaataacgtcacttaaagccgctaatgattcttctgtataaatatctgttttttctaataattcattagcttttaaaatttgtttatccagtagctgagttgaaactttttcttcatctaataattcgcatgaagcaataagaattctatgatcagaaccaatttcatcagcttcataagcttctacttccttaatttcaatattccgagtagtaataatattgtcaattgcatttgttttcatagaagcatcaaatggtatataagtatccagccatttgccatctttaccattagcaatattataattacgcaaataaagatcaaattcatcattgctttcttgagcattaaagtctcctgttaacactttatactctgtttcatcttcatccatagcatccaatactgcctccatttgactagcacgaatacttggatcttcccaagttaaatgagtattataaatagcaatttctttttctccaatagttatttttgcacattgccagccacgaccttcataaccaccagtttctaaatcagcgccactttcatcagttagatcaccattagccaccatcccaattccatattctccgccagaataatcaatactcttacgaaaataataatcataaccgacttcgtcagcaatctcttttagcatatctttgggatttctacctgtatttttatctacttcttgaaatccaacaatatcaatttcttcactttttaatagatttccaattgctcttgtactattacctttagcagcaatattataagaagcaatcttaaaaatattgtcccctgttgcatttcgagatgttaaagctacaagtggagtaatcgctgacatcaacatcgttacagacagcatccccgaaaatatacttttccacttcttcataaacattctcctttcccgtattttttatcgatcgttttataaagatcaattattattttatctttttaacattttttaacaatttaaaattataggacaatctttttacaaaaattttcacttctttatctctttctagaaaaaagaactgtaacgtgtaaataatggaaaatgagatcttaaggtttggatatttttttataatagtgatataatttatattaacagtagaaatctactattaatataaataaaaaataaatatgataattaaaatttttgatttatgaaaactaattagttaaaaaattattttattagcaggtgccaaaaatggaaaaagaaactactagccgaatgaattatattattgaactgttgttattaaaaaaaaatatttctattaaagaagtttctaatagcttaaaaatatcactacgacaagttcgctatgatatatcaaaaattaatgaaaatataggaactataaataatgttccggtaatagaaacggataataaaggaaacataatcattaatgatatagaaagactattgcaatttactgagtatcaaagaaaatcatttaaattcttaaaaaaacagcgaatagatttattagttgttataattgctttgtgtatagaagagcttaatctaaataaactgtcaaagcaattaaaagtaacaagagtaactgtaaaaaatgatttaaaagaaatagaacaaaagttaaagcaattcaacatacaattaatgtattcaaatggtttctatttagctggaaatgatgaagatatttttgaattccgattagcatcttttaaaataattgaatatagtttatttaaagataattttgagacaattgaggacttaatacgcgaatacattttaaaaaaatttccccagattaaactaagagatatttttccaattataaaaaagtttattaaaaaaaataatattataatgaatgatccagaactatattggtttgcatcaataattatcttgatgtcatggtatatatataacgatattttaatccctgaaagaaggcatcttaataccaagttacaaaattttgaatatgatgaattttttatagatgtagaggattttgttcatataacaataaatgaacaaaataagaaaaagatgataacggcaatttctgcgatttgttataatggtgcaattgaaaaacatagtttaaataaaaaagtaatttattatatatttcaattgattgattctatgcaatgtaaatatgctgaatctttcaaagaagatttagatttattaaatggattgtataaacatttagtttgttgctattacaaagatatagctaaattagaagtgtctatttttgaagaatataattttacattagatgaagaattagaaaaacatattgatagatttggaacagttaataatgaaataattgatttgtcaaataaagatgagctgtcattattaaaattgcattttgcaaatagcatatatcgcaaatcaaactgtaaggataaaagagttgtattgattagtggaacgtctaaatttaatcaaatgcagctaaaagattttttggagtcatcatttgaaattgaaatagttgatattatttcaaaatatgatattccattttttcagcaatggaatgaacttgatttaattttatttacagaaacaataccagaatattttagtagaaatattcctgtcgcaaagataaacttgattttagataatactgactttatattgttaaataatttaggagttgtgccacggaaaaaaacaattaatttatatgatttatatcataaaatggattttttagattataaagaacggtttcaagtgcttcaattagtaaaaaaatcaatgaataattatgtttccttttttgatgataaacaatataatccaattgaaataaataaagcagatgatttagaaattgatcaagaatatatttatgtagatacaaatatatttttaacatatgaattaggagagattaatcagattaattttgccctcaaaaaagataagatcatattgcaagtaataggaacaaatgtttctatattatgtaatcttttatttagatgcaaaagaaaagttaaagagatagatttttttaagatgaatgattctgagatattcaattttttactagatgtgtaataaaagtagttaagggataaaaaaagggaaaatttatttcctttttttttatctattaaaataatatcaacttgttagaatataaatataactattttatcaatatgaaaaaaggagggtaaatgaatgatttgattacacattaaggaaaggagaaaagaacaaatatatttgtcaagactttattaacaagctcgattaaatcgattttggtaattaatgctatatagacaaataaaatatacattagatgggacacctagtgtatacaaatgacttattttatatttaaaaaccagacaaatcaagtgatgatattattaggataaaattattccagaaattaagaaggaaaagttaaaagttgattttgatagagttttaataatagatagtgagttatattttggtacttacaagatgtattatgattttaaaaaaatttaatttttatcctaaattatcacttatctaaggtaacattttacaatgaatgtcactttttttatcatttatactaaaagtgtaaatataaaacacttatataaaatgatataattatttgtaatattttaaaagcaatatgattatacgtgtaataaattgttacaatattacgctattttattaaaatatcaatattttataaatatgtatatcaaaagtaaaaggaggtaaatgaaattttggatatacatattaaagaaagggaaaatgtatgaaaatatttgtaaaatctttattaataacttctttattagtaggatctgttgggccgatatcattagttgatgctgtagaaaacgatgatccaacaaattttactgaaaagataaattacgcattagatgggacacctagtgcatatacgtcacctatatcttattggggacctgataaattgatcgatggtattatcaatcgtgatgcaaataaacctgaacaatctagatggtcaagtgaagtaggagctccaggatgggtgaaaattgatttaaaagaacaaaaaacatttaatgaatttttattagcttttgaaaattctaaagtacaacaatttcacatagaagtatctgatgatgatagttcttatacaaaaatttatgattcagaagttaaaacggatggtcatgaccaggatactactataaatcttgatcaggcagtcacagcaagatatgtaaaactaactattgatgcattaatttctggtgcttatccaagtgtatcaatgtatgaattcggaatttatggagaagaaaattatattaattttgcgcgtgaatcatcagttgaagctagtgaatgtgaagtaccaaaatttgatgggccaaatacaattgatggtgatcttacaacacgttggagtgcagagggacatagtgaaaaaacattaacatatacgtttacagaaccaaaaaatttaagatcgttaattttagaatgggagagatgtaatccaacaggatatcatatcaagatagatgaagctggcaactggaaaactgtatatagtggtggaacacctgctaattttacagacaaaataaatttggatgaaacatatgttacttcaaaagtacaagttgtgattgatgattttgtcgataattcaccaatgcgagatggtagtgatatgaattatccaacagtatcattatttgaagtacagatgtacgataaagaattaattattccgccagacccagttgtaactgctagcgatattgctaatggaattactagtgcagagttaaacgaagatgaaacaatgctggtaatgccaacagttccaaaaggatttgaagttaattttataggggcagattatgaacaaattttagcacgtgatttaactgttactaaacctttaactcaacaagatgttgtggtgaattttgaagttacagatactgaaactggagaaaaagcagtatctccggcaataacagtaacagttccaggaatttatgataaagctcaatcacaaaacgctaaaccaaaagtaattcccgaattacaacaatggtttggacatacaggtgtatttgaaattaatgaaaatagtaaaattgttattgatccatctgcaagtgaatttatgaatactgctaatatatttgctgctgattacttggacattttagataaaactattactgtagtgagtggaactgatcctcaacctggtgatttttactttaccttaagtgatactacattagatgaagaaacttatattatggaagttgatgactatataactattaaagctagtgaaaatacaggtgcatactggtctactagaactattttacaaattttaaaacaaagtggttcacaaatagctaaagggatcgttaaagattatcctaaatatgaagtacgtggatttatgctggatgttggaagaagaccatttaaaatggatttcttaaaagaattagttaaaacaatgtcttggtataaattaagtaatttccatgtacatttgaatgataattgttttggtaagttagaagatggaaaaacaccagattattcagggttccggttagaatccgacatcccaaatttaactaatacagatttatattatacaaaagatgaattcagagattttattaaatcatctaaagaagttggagttaatattgttccagaatttgactctccaggtcattcaggtgcttttgttcgtgctagacctgatttagcaagagcagatagtaacgaatacttagatgtagaaaatccagaagcattagaatttattaaaagtgtatttgccgaatatacaagtggagatgatccagtatttcctaaaggaacagtagtccatattggtactgatgaatataaaggcggaaacaaagaagcatttagaaaatttcaagatgaattgttaaaatttattcgtgatgaacaaggatatacaccacgtgtatggggaagtcaaacagaaaacagtggtactacaccaattactgttgacggtgtagaaatgaatctatggtatgttggatatgcaaatccaaaagaaatgtatgaaaaagggtacaaatgtattaattctaatgatggagatttatatattgtcccaggtgcaggatactattatgattatttaaatcaaagtcatattgctaattcatggcaacctaataagattggcaattttactattcctgtaggtgatgatcaaatgttaggttctactttccatgtatggaatgataaaacaggacctgctaatgataatggtacaagtgatttagaagtatttgatcgtattttccatatcttaccaacttttgcttcaaaattatggggagatattaaagattattcaactgaagatataaacaaattaactgatactattaaatatgcaccaaattctaatccaacatatgaaattgaaacaataggagataaagttcttgattataattttaataatgataaagggttagataaatcaggaaatacattcaatttaattaatcaagaaaatatcagttatgtagaaggtaagaatcgaaacgctttatctttaaaaggcggaagcagttatgttgaaacaccattagaagatctgggtattaattcttatttagaattctggatcaaacgtgatagtaattcatcagatgatgaacagattatttttgaatctgaaaacggtgcaatcaaagccgttcaaaaagatacaggaaaatttggatttagtagagaattccatgattattcatttgattatgagctacctaaagacgaatgggtaaaaattaaaatcgaaactaaatttacatcaacaatattatatgtaaatgatgaaaaggtagatgaattgtctaagagcggtactggtggaaaatgggctagcttagttattccattagaaagaattggaagtaagacaaattcatttgttggcttaattgacgacgttcaagtatctaaaaaagctgcaacaattaaagcaactagtacttccgaacagtcttcggataaagctagtaacgctatagatggaaatccagatacaatgtggcatactaaatggagtggtgaagatgtattaccacaaagcattacattagaattaccaaaagcaacagatatcaaaggatttacatatctaccaaggcaaactggaaccaatggatatataacagattacacaatttctataagtaatgatggtgaagaatttactattgtagccactggtaattgggatgctaacaaagagcttaaacaggttgattttgatgaatgcaacgcaaaatatgttcgtttaacagcaaatgctggtttaggtggatttgcaagtgcagcagaacttagtgttattaacgcaaacgaagaatcagaattaaatacaagaacattggaagaaacaatagaaatagcagaaaatctattatcaggaaattatactcctgaatctattgctacattgcaggaagcttgtgatgaggctaaggaagtattgaatagtgcaaagactcaagaagaaatagatgcagttgaccaaaatcttaatcaagcaattaaaaatttaatagaacaagttgaggctgaaacaaataaattagcattacaaattgccattgaaatggctgaaaaagctgatttagaaaatgtcgtaccagctgtagtaactgaattcaatgaagcattagaaaatgctaaagcagtatacagtaatgaaaaagctactcaggaagaagtaaataacgcctttgatcgactagcaaatgcaatgcagatgttggaattctatcaaggtgacaaaacagcattacaaaaacaagtagatcaaatcaaaggtttagatgaaagcaagtatattgaatcatcatggcatgcaatgttaccagcattagataaagcaaatgatgtattagcagatgttaatgcgatgcaggatgaagttgatgaagtatatagtgaattagtaaaagcgttcttgaacttaagactaaaaccaaataaagacttattaagcagtttaatcaatcaagctaatggattaagtgaagcaaattacacagcagcatcatggaaagtgatgaatgatacattgaatgaggccaaagcagtattcaatgatccagaagcaagtcaagcagaggtggacaatgccaaagatgctctaacaaaagcaatggcaggattaacagcaaatccagttgtaacaccagtaaaagccggagatacaacagtaagtgtaaaaacaggagacgatgtatcactaggaatgttaatgagtatagctggattaagtgtattaggtttattctatagtaaaaagaaaaaagaaaatatctaataaaatatgatgaggatgaatgttatgggtcacccataacattcattctctttttttactgaagaataaattagtgtaaaatagatttacattttttttgactatttaaaaaaaagcagatttgttaaaatcttctcataaaatacatttatttaatttggaatgttactttaaataggcatgaccataggataaatacggttaggaggtgtatttataaagcggaaataagacaaaaattaaattatagatatttattaatgagaaaatattaataaatagtaaaggataaacctctttatgataatttttaaaagataacgaaagttaaaataaagaggttttcttttaaaaaaattttgggaaataaagaagttaataaaaagttattttgataatcatgggattatggagattgaaggaatggaataattaattgaggaaaatggaactattatagcttattgaagaggagaaagggaaatgaaaaaaattaaacaaacattaaagttttttttaataacggctattattttgacagctgtgttgtcaaatggcttgtatgttaaagcaacagggaatcgagtaaattttgcattaaataaaccagttgtaggaagttatcaagatagcccaagtcattctcctaataatgtcgttgatggggatttatcaacacgttgggggactgatccgtatggtacaaatcaatgggtatgcgttgatttggaaaaaaattatgtttatgatgaattttatattgcaagtgaaaatagtgaggctcagaaaatcaggcaatttaaaattgaggggtctaatgataataatgtatttgaattgatttaccaatctgatgataatcaatctggatatggtttagaacaaacaattaaattaaatgaagcggtagattatcggtatgttaaaatcacagttgaaaaattaattagtggtgcttatccaagtgtatcattaagagaatttggaattattggtaccgaggaagaaaggataagtgacgttaaaactgctctatcaaaattgagtattcctcataatatatatcgtaattttaaaatctcattgtatgatgaagaactaggagtagatttttcttggaagagtgaaaatgatgcagtcgttattaaagatgatactgtagtgatcaatagtgattcaaatgagaaaaaaggaactttaatcgtagaagctagtaaggatggatatagtcaaaacgaaagttatgcatttgaagttaaatcattacaaagtggcgattatagtatttatcccctagtacagcaaatgaattatgggaacgatgttttaaaaataaatgataaaataaatgttgtaatgtatcctggaatggatgaaagtatttctaattatttaattaatttatttaaagaatatcaaatcgaagttatttttagcgatgaaaaaagtgacgacgcattaaatatttatttaggtataaaagatcaaggtgatttagcagaccaatatttagcaggaaaagttgatgatagttcaattgcaggaactgctgatggatatgttttaaaagtatgtgctcaagataatattgttgccattgttggaaacgacgtttctggaacatttgatggtgtttttacattaaaacaaatgctagcttcatcaaatgaaagtttaaaagatgtaactattattgattcaccagatacaaagtttagagggatcgtagaaggtttttatggccaatatacacataaagaaagattagacttattagcttttatgggtcctcttaaaatgaatacatatgtatatggagcaaaatcagatgcatatcatcgtaataagtggcgtgatttatatccagaaaataatattaatgaaattaaggaattagtaactaaaggtaaagagaataatgtagaattagtttggacagctcatgttggtggaaatattgatatgggctctcaaagtgactttgatgcattaataaataagtttgatcagttgtataatataggagtaagacaatttggtattttttatgatgatgcttacactgatagtacatatttagttgaatttgtaaataaagtgaatcgtgaatatattcacaaacgtacgggagttaaagatttaattatttgtccagaacagtattgtaaaacaagagtaagtggtaattatttagatttacttgctcaatttgatcaagatgttcaaattatgtggactggagatagcgttatttcagaagtaaatccttctatgatggaatatatcgaatcaaaaataaatcgaccagcctatatctggtggaattatccagtgaatgatttaggcatgggtagtcaattattagttggacaaacagttggattaagtaatgaaatgggtaaaatgaatggattggtttctaatccaatgttacaagctcaggcttctaaattctcattatttagtattgcggattatggttggaatattgctgattttgataaagaggaaagttggaataaagctgttgaatatattattcctgaaaaagaatatgcagaggcatttaaattgtttgctgctaataataatcaatcagttgcagagttacaggatatagcagttgaatcagaatatttaattgaatcacttaatgtttttagagaaaaatattattctggtgaaaatattgaaacagaagtaaataatttaattgaagaatttaataaaattgaagaagcatgtttattattgaatgaatataagggaaatccagaattagttagtcaaattaatccatgggtaaataatttgttaaaagttgtagaagcaggacaattgactttaaataatatactttatttaagtactcatgatattaatgaagcagttacaattgcaaatgtacaccaaaactttttggaatgccaagataaacttggaaatattgggggacaatggtctggaagaagagtattgttaccatttatttatgaaatgcaggatgttttagaaaatactatcaataatcaaatgaatgaacatatagtattgagaacagttaccaattatcgaaatggtaactttgtaatgatggatttggataaaatgattgatggagatataaattcatatgttacatttgatcaaaaagaagttgctggaaaatggtttggtgtagatttaggagcaaagatcaaagttaataaattagaaattttgattggtaaagatgcacgagatcaagatgtagcaagtgattataagattcaaatttctaataatggtattcaatggactgatattgatactactaataataataacagaataatgaatagtaataccttttcaacaagatttatacgttattatgttgaaaaaggatgtaataaaaatgtaaaagtgcgtgaatttagagttgatccaatagataaagttatatttactaatagtgacaaatatcaaaaaattgatgtcatagaggaaaaaagtattgtggagattggtcacattgataattttatgttggctaatggagaatatataggaattcaatttgaaagagcacaagaatttacagatttagtagcaaatgctgaattaaatgatttaaaattagagtattcgatcaataaacatgactggttaccatttgaaggtgaaaagtttgtggctaaatatattcgtttaataaacaaaactggtgaaaatttcaatggaaattttgaatatttaaaaacagttggatccgaaatagtaactattgaagatcaaattgaagttacaaaaagtgatgatttagtcatttggtcaggatcaccaaatgatctaattgatgataatcgcgatacactaatttggacacgtgatcaaaaagccgggcaaaattatgtgttagatttaaagaaagaatatccaataaaagatattaatgttgttatggtatccggtgacgttatgaaagaaggagttgtagaaatttcatctaacggaattgattggaaagaaataggaataattggcgaaaaaacagaaaatctaattgttttagaaaatgaaacagcacgctatattaaagttacagttactaaagactcaagtacttggttaaaaattaatgaaattgaaattaatcaattaaatagtgatacacaaattccaatattagataataaacaggcagaaacagctattgataagaatttaactactaaattcagtggctctaatagcgcaggaaaactagagtataataatgttaatacactaaatgcaacaacattaaatattttgaaagataacaaatcaaaaattaaagttgaaggtttatttaatggcgtgtgggaagagttgttccaaggtagtgatgcttatatgagtattgattttgctacaatgggtagtgctgaaagattcaaaattagttgggaagatggaagtaatccgttattctatgaaatagcaacgtctgttaaagaagtttctttaaataaagatattttaatagctttgatcaatgaagcaaaaaaacttcaagaaagtgattatgtaactgatagttggaaggtattatcattagcattacaagaagcaattgaaattttagaaaacgcttcaaatcaggaaacaattgatttagctgttgtagaacttcaagaagcgattgacaatctagtattaatacatattgaagaagtagataaacaagcattacaaattgctattgataaggcagaagttgctgatttagaaaatgtcgtaccagctgtagtaactgaattcaatgaagcattagaaaatgctaaagcagtatacagtaatgaaaaagctactcaggaagaagtaaataacgcctttgatcgactagcaagtgcaatgcagatgttagaattctataaaggtgataaaacagcattacaaaaacaagtagatcaaatcaacaacttagatgaaagcaaatatattgaatcatcatggcatgcaatgttaccagcattagataaagcaaatgatgtattagcagatgttaatgcgatgcaggaagaagttgatgaagtatatagtgaattagtaaaagcgttcttaaacttaagactaaaaccaaataaagacttattaagcagtttaatcagtcaagctaatggattaagtgaagcaaattatacagcagcatcatggaaagtgatgaatgatacattgaatgatgccaaagcagtattcaatgatccagaagcaagtcaagcagaggtggacaatgccaaagatgctctaacaaaagcaatggcgggattagtagctaattcagatataactcctataaatctaggagatacaacagcaagtgtaaaaacaggagatgatgtatcactaggaatgttaatgaatatagctggattaagtgtattaggtttaatctatagtaaaaagaaaagagaaaatatttaataaacaatgatgaaaagggctgtaacggaaataagtaatttttagatttattatttagaagcgttatagcttctttttctgttttatagatgaatttttgataaatcattttatattaattagttttcgaggtattattgcataaaaaatctttttagacgcaatgaggttatctgactaaaatcttttataggggaaaactttgtttctttgatcaatgaatagtaaacatcgactccttccctacagaaatatctgtttaaacttttaatcagatttatgaatttttccatgtcctaatatagtatttttgagataatttctttcattattttattgatttcgataaaaatatcatcaattatcatagtcaaattatctttaataaatatttcaaagggcataaaagatagtattatttaaagcgattgtcaaatctatataattcttcatattctcttatgaaaacattttcctaaaatgatatattcatccatcatactcgtatatatttcagttaaagaaatcaagatattttgtaagattgattctttctacaatactcttgttcttgaaatgtcattcataggtatatgtcataagaaactgaaaaatctaatggtaatttaattataatttgttaattatacaaaaaatgtacgattatctcgtacatttttgcgttttgatctgttttaatccttataggtaagttacaatcactttttaataaaatattcattttttcatattttatcaatttaaatgtttaaaaataataaccataaacatcacattaaaatttatttggtttatcaaaaacttcgtgacaatgtctacatcttggctcataatgctcaactgcacctactagtacaatcgaatcattgaaagatgctggttttccattaaccaatcgttgggttctggttgcaggagcaccacacttagtacacacagctgttaacttagtaacaaactcagctcttgtaagtaattgtggcatcactccgaaaggctctcctctaaaatctttatccaatcccgcaacaataactcttatccctttatctgcaagatattcacaaatatccacaatatcagcatcaaaaaactgaacttcatcaataacaacaacttgtgtgtctgcttttatctcttttaatatttccgcagctttattaattactaaacatggtactttaattcctgaatgagacacaatttctatagctgaataacgatcatctatccgaggtttaaaaacaataatcttcattttagcataacttaatacatttattctacgaatcaactcttctgttttacctgcaaacatacaaccacaaattacttctagccagccttcacgatattgatgatacatctaagccctccttctagcttctaagatcacgaacaccctcactagtgccatctggtcctacttgggctaaatccgaaaaacggctatagtttttttcaaacgctaaattgacttctcctgtagccccatttcgatgttttgcaatgattatttctgtcaatccattatcttcaccttcactaggatctttataataatcttcacgataaataaacgaaactatatcagcatcttgttcgattgctcctgattctcttaaatctgacatcatcggacgcttattaggacgttgttccactgaacgtgataattgtgaaagcgaaataatcggaacttctaattctcttgccaacgcttttaacgttctagaaatttcagaaacttcctgttgtctactttcacgattttttgaagatgaagtaattaattgtaaataatcgattacgatcatttttaaaccatgctccgtttttaattttcgactttttgcaacaatatcattgattttaattcctggactatcatcaatatataaattacatttagaaacacgttctgcagcagcataatatttattagcattagtttttaaaatttctccggtacgcattgaagaaccttcgatacttcccatagagcaaataatacgctgaactaattgttcagctggcatttctaatgagaaaatagcaactggttcatcggctttatatgcggcgttatgagcaatattcaaagcaaaagctgtttttcccatcgctggacgtgctgccaaaataattaaatcacctttttgaaaaccagaagtaattctatcaagatcacgaaatcctgatctaacaccagaaatatttccatcgatcttttgcaataaatttaagcgatctgtgacacttttgataacactacgaatttctctaaattcaccagcgctacgatcttgagtaacttgtaaaatcgttttctctgtttcgtcaataaaaacatctatgttctctacatcatcataagcactttcagcaatcttagtagtttctttaatgattcgtctaagtattgctttgttatgcaatatttttagatagtaatcactatgagctacagtaggaacagattcgcttaaacgaaataaatagtctacaccaccgactttatctaattgattatgatccataagataagatgttacggtagtaacatctactggtgtattatcatcattaatagcagccattgctttaaaaatagtttgatgattattatcataaaaatcatcttcattagtcttatttaaaatgtcaatgcatttatccttcgatattaacatcgccccaagcaatgatctttctgcttcaatatcatgaggatactctcgatttgccatactattctcctactgttcttttagatgaacatttattgttgcaattattcccttatataactcaacttttaacttcgtatatcctaatgctccaattggatgagcatcaacaaactttcttttatcaattttaatatcatatttatctcttagctgttctactatttgtttagttgaaacacttccaaatgtttttccatctttacctgatttcaaagtaaattcaagagtcactgactctatttgttttgctagttctctagcctttgcttgattttctaaatctagttgatgagctacttctttttcatgttcaacaattttacggcttgtattagtttctaaaacagctaatttatttttaattaaaaaattttgtccatagccatctgcaaccttaactacatctcctttttttcctaatttctttacatcttgtaataaaataactttcattattcactcttcctttcatctaaatatgtatttatcgcttcttctaataaatttatcgctcttgtaacttcttctgttcttaattgacaggcagccatcgaaaaatgcccgccaccaccaagtttttccataattaactgaacatttatatctcttgtactacgcgcactgatcgaaacttcctccttaccagtttttccaactataaagactgcctttacaccgctaattcctaacagttcattacccgctttagctaataaagttctgctatagattttatcagacctaccaaaagcaatcaagatatcatttccatagcgatatgcagtttgcgtaattgataatttcgttaaagttgtatcataatcatcctctaaatacttatatgcctcactaacatttgcctgcagttcttttaattttgctgcagcttgaaaagttcttgttccgactcttgttctaaaataatttgtatcaattaacattccagtatacataattgttgcttctcgttcagttacactgattttttctttttgatattcaaataattcaacaatcagctcaactgttgacgaagcagcaggttctagatatgtcagtaatggtaattcaataaattcttcaccccgacgatgatgatcgataactactttattttttactaaatctaaaatattataatcgatcgctaaagatggcttatgattatctacgatcactaatagagtattagcctgacacaactcttgagctcttagtggtgatacaaatactccgcgatatctttcatcatctctaagacttgtagcaattactttagttttttcttctaaagaatcataattaataatgatcgatactttcttttcataagccttacacatcgcatacattgcaatagaagcaccgaaagaatcaaagtccgattgcttatgccccatgataagtacattgtctgactgttttattattgttgataatgtttgggcaataacccgggctctaatcatactagatttttcataactttcactattaccaccaaaataacgaattggttcatcgttagatttcacggtaacctgatcgccacctcgagaataggccaatgataaggctgaaaaagctaattcatctaattcacgcaaaatgttgctgccacgtcctattccaatcgataatgtcattacttggcctaactgttctgcctgttccttaaaataatctaatagcttaaatttatcttctacctgctttcgataagtacgttcattaaagacggctatatatccatcgcttttatatctttttaaaactacaccattttctttagcccaatcaataattatttgtcttgttgtcgattgaatcgaagctgctgtctgttcatctgcctgttcaatcgattcatcataattatcaatggtgatataggccacacaaatttgttgatcttcaaattcttttgaaattccaacataatcactaacatctttaagataaaggattctattttctttactattatatacttcatactttcgcgaattaatatcaataatttttatatcatcatcttcaaataacgatgctaataacggttgccactctaataactttttacctacgatatttattttcatttctgtaaatagatcacttatccatgaaatatttctattttcgtcatatttaattaatccaattcctccaaaaataaacgcatttttagcctcatcattcaaaatctcactaacacttaaattattttctgtaaccaaactagttgcataaaaaagtaatccaaaaataataatgtttttaacaaaaatatatatcgccaacactaaagatgttctacttgaaaaaaagatataacctaacattccaataaccaattcaatcagcaataagatcataattccatttctaagtcgtgccatctttaccgtcattttcctcaccatcctgtcaacaattttattataccttaattcaattttcttttcattaacttacttattaatatatctgaatacactctaataacatatgactcacaaacaaacataaatagccataataaaacaaatgtaatttctggcgtaaagatattttttaaatacggaatcattccaataatatcactatatatctctaaaccttcttgataaacattgattcctaaaagacctcccaataaaaagaaaatcaagaaatttttaactgctgaaataatcattaacccatatttagaaaaatgcttcgtttttttactttttaaactataaccataaaatactcccatgcttaatgtagcagttgcataaaatgcaaaaaacatttcaccaactaaaaataatactacaaaagttacagctaaaacacttgatccagctttataaccatataaataagtgtagtaagttaatcccaaaaccattatataagcaaaaattatatcaaaaaaactaccagtatagatattaataattcctaatacgccaaataacgatgctaacattgctccttgagccattattctaactttacttccactcataattacctccattatatcaaaacacttttgctaatcatctaagacatatttgtgcgttaatttatcaaataataacatattaatgacttatattcaattatcatgttttcaacaaatttaaacactatatatttttactttcattttacaaaaggactttttaacctatttaggacttttatgatattgtataatattaataatttggtctataattagtaataggcgcaactaaacctctcccagttgcgcccttttttattatattaatatcaattatttgttattaatatattctttaaataatttattttaccatgacgtttactactcactttttaattctcgtccattcatcatattccgacatccatataaaattaaaaaactaacagcaaaattcattattaaactcacataacttccccatattatagctctacttccaacaataagataaattacaacaatgataatggcactaggaatagatcctattaacattattatcattctcataaaattttcaaacattgctgaagaacgactcttaagaattctaagtgataaaacattaccactaataaaaatacttgtatatcctaaaacatataataagtaagtaaaaatcattactaaattaatttgataatataatcccattaaaataaaagcaattgctgttacaataaatattttaataaatgtaggcacgattacagctattaatttattaaatggtttatcgggaattaaatatatttgataattcttcaattcatttgtcaaagcagaattttgcaatgatgaaaaaacccatataaccatcatataaacaaacatcccaaaaccaatgtcagcaacgatcgttaccacaatataaataccaattgaaattaaatcattgatgccaataaaattatttgtctttttcatcaataatatgtttttagacatgactgcataagcgccttgtttaaaatttccagaaacactctttttaatttttatatttctaagagcatcttgattaccagcctttacttttttcattcttcttgataaatccaaagcatcttgtaaagcttgttcataaaagtttcctttataattaataaaaagcgcatatactagaattattgcccctaataaacagccaaatcccaataataccaactgataattttgttctacatatgccaccaatactaatttcatccagccaaaaaccggtacaatataaaataaatcagcttttataaaatctataaacaatgtcttataattacctgtttggatatatataactataataatcaatgcaacaaaagctatgattatagcaggtatgagctttgaataaatacgatatttttcatcaccaatcgataaaacataaagataatctgttaataacaaaaagaaaaatactactaatgttgatactaaataagcaagaaaaataaatgtaaaagtataaccacttcctacactaaaaaaagcaaaaataactaaccctatcaggctcagcaatgctgattgaactgtcgtttgaaatgttaaataactcatgatttgtcttttagtaaatgggcctgtaaataaataaaaagcatcttcaccataaaataaagcttttttagactgcatcaaagttgaaaagagcagtaaagctagaaaaccaattaaaattaaaatacttatatgaaaatcatttttatttgttgaaatcatttgcgtattatcgatattaaaaagactaataattatcactccataaaatataatcatgataattacaaaaacaccactaagtttatgtttaaataagtttctaatcgttccttttaatttcaataaccataatttaaataatatccccattttatttaccatccgttaattcaaaaaagtattcttttaatgtttctttttctaactcatcttttaaaacatgtttaataatttttcctttattcataatatatgcctcatcataaatgtcatctacaatatcaataatatgggtacttattaaaattgcacaaccttctttttttaattgtttaaaaatattcagcacatcttcaatacttccaggatctaatccaaccattggttcatctactaacaatgctttaggctgtattaataaggctaataacatgctaagtttttgggtcattccttttgatagttctttagcaatactttttcttttttctataattttaaataattcaagatatttttgagcaatttcttgataatttttaattcgataggcattaccaataaaatcaatatgctcatcgaccgttaataaatcatataaaattggcgtttctggtacataaccaaagcactttttagcttcaatcgtatcgttttcatacccgcatatttttattttaccttcaaaattcaataaattagcaatacttttgattgttgttgatttacccgcaccatttggtcctaataggactgttatttttcctggtttgacttcaaaattaagattatctacagctttgaaaccatcatactgtttcgttagatttataacttcaatcataaaatacctccttttataataatattaatatatattatttatatttggcaaacataataataaaaagttagataatcatctaactttcctctataactcccattaattccaaaattcgattcaaatccttagtatccgtatacttaattaccaccgatttatcatcaactttgatttttgtcctaaatttctttcgtaacaacccttcaacataagtatattctttaggtttctctactttaggacgatctttacgactatttcccagttcaattcctttaacgatattttcgatatcgcgaactgatagcccttcatcaatacaccttttagctaaactctcagctttttctttaggtaaagttattaaagctcgagcatgccccattgtcaatttaccttctaagacatagttttgaatcatttccggcaattgcaataatcttaaagtatttgcaatgtaacttcttgatttaccaattcgtttcgctaactgatcttgcgtaagttctaatttttccatcattgcttgataagcatttgcttcttcaattgaattcaaattttctctttgaatattttccagtaaagctatttccatcatttgatcatcgctaaattcaacgattatcgctggtacttctgtcaatccagcaattttcgctgctcgacatcttctttctcccgcaacaatttcatatccttgaatcgatggttttaaaataactggctgaaagattccatgttccttaatagaaactgctaattcctgtaatttttcttcgtcaaataatcttcgtggctgataaggattaggacgaatttcatctaatgcaacttttacttgttttgattcaggcgtatttttttctatatcatcaattaaagttgatatatctccgccaaaaatagcgtctaaaccttttcctagttttttattttttactgtcccacttttttttacggtcgtttttttagttgtattacttggcattacgtttacacacttcctttgcaaaatctcggtatgctctagcaccttcggaattattatcgtaatcaaaaattgctaatccttctgatggcgcttctgataatttaacatttctaggaattgctgttttataaactttctctttgaaatatttacgaacttcctgagatacctcaactcctaaattagttctttgatccagcatcgttaataaaacaccttcaatcgttagtttcggattaaacacactttgcgttaacagtaccgtatttaataactgtgtcaatccctcaagggcataatattcacactggactggtattaaaacagaatcacatgccgtaagggcatttgtatttaataaccctagtgccggaggacaatctataataatataattataattctttttaacagcatctaaagctttttttaatcgttgttctcgaccacgtttaacgtttgctaattccaaatcagctccggctaaatcaatactgccgggtgccacatcaagtttagcaatatatgaaggtatgatcacatctttcatatcacattcttcaactataatattataagtagatagttcaatattatcacgatcaattccaattccctgagtagcattagcttggggatccatatcaactagaagtacccgatttttagcatttgctaatgctgctgctaaattaatactggttgtcgttttcccaacgccacctttttgatttgtaatcgcaattattttcgtcattatttaacctcctttaagtacttcctgccaatagtctcacctagtttaactaccgtttccttattcttatttgtattttctataatatcgttatcaatgactacctgattttcttttaataaaataattactgtagaaccgccaaattcaaaatatcctttttcttcacctttaagacaatattttttattatgattaacaattttgccaaccatcattgctccaacttccatttgaatcatcattccaaaattttttgaatcaataatagtgtaatttcgactattttgtttataaattggataataatcattagctatcggattaactgtatgaaatattcctgggatatatttactttttataattttcccatcatcaatgaaactataacgatgataatcatctactgttaatctaaaaatcatgcaataaccatttaaatattcattagccaatttttcatcatccaatagatctgctaatgaataaacagtatctttgatcgtaaaatgactatctaaaccaattttatagcaagtcaatttagaatccgcaggactgatcaaaacattatcatctactaaaaaaggtctttttccatcaataattttacgtgtaaaaaagtcattataactagcatattctctttgttcatactgactcatatcaatttcattagctttgataaatccttcgattctagattttgataaactagaattcatgtaccagccgccaatattacttacaaatctacaaacaaggacttttaaaacacatctccctaaaaatgtgccatataatttttttaataaattattttgattctcccctttagttataacatttcctaaacgatcaacgactatcatttcatcaccacaatctgaattaattccacaataacaaggatccctagtgccactaatccttttgattgaaccttaggaaccttaaaatttacaataaataaaattcctgtgatcaacattaatgccccatatatatatgataattcaaaaaccacataacgtaaagcatatgccattggcaaaataaatgaagacgttgtcactggtaaaccttgataatattttctcttttcgttagtttccttctgtcttgtttcttcttgaacattaaaataagctaatcttattactgcagctaaaacataaaatatttcaattgccagccatcccatcgaacttaagccaacattataacctaaaatagatggaaatacaccaaaagcaactaaatcacataatgaatcaatctgaattccaaaacgtttttcttcatcagtacgatttttcttactacgtgctaccattccatcaaaagtatcacagataccacacatgatcaaacaaataaaagcccactggtacataccattaaatgatagatgaattccagccattgcaaataccaatgataaatatgtaagaataaccgtataactataataaccgatcatttttctactccctaataattttttcaacaaaaacagtatagcacatatttaactaataaggtacattaatctaaattttgtaactcaaataatgttttaaacagcctcaatattatttaaaaactacctggttaaaggtagtttttaagttgaacagatctttatattagttctttttataataacgactgccactatataaaacgatttcctgcttttttaaagttaattgaacatcgattactctttgattagaagaaccacgaaaccttaatttacgatcttttaattcatctacaaaaggtccgtctactagtatatctatatatgataatatctcttcatcaaacttttcaatctcctcatatagataagatgaataaagccatatcgttttattttgacagtgctgtttaaccttctttaataagttagatatatcttttcgattttctggttctaacggttcaccaccaagaattgttaaaccgacaatatgaggctgatttattaactcaatcaaaatattttcaatttcatcatcgaacacttctccaccattaaaatcccatgtttctggattaaaacaattaggacaatgacgatgacatccctgaacatatagcgaaactcttattccctcgccattagcaatatccgtttttcttatctgagcaaatctcattattattccccatatagatgattatctaaatgaacaaaacgctcggcaatttcctgagttctcccctgattccagaaattatcacctagatatccgcatgtccggcgacatacatttaatgtcttatgattacgattgccacaatttggacaataccattcacgattttcatctaataaaatctcaccatcaaaaccacattcttggcaataatcagatttagtattaatttctgcatattggatcgtttcatacatataatcgatcaaagcagaaagggcatctaaattttctgacatattagttacttcaacataactgatcgcgccaccagaagaaactttttggaatttggcttccacttctaatttttcaaaagcatcaatatgctcttttacattaacatgatatgaattagttaaataatctttatccgtaattccttcaacgattccaaaacgttttttcaacgctcttgcaaaagtatatgtagtagattctgctggtgttccatataatccaaaaccaagacctgtttcttccttccagctgtcacaagcttctcttaaacgttccatgatcttagtagctaactcattaccttcttttgaagtatgggtttgccctattaatgccacgacacattcatataatcctatatagccaagagaaatagttgaataaccattttctaataatttatcaattttttctcctgatttcaaacgggctaaagctccataacgccaatgaatcggacttacatcagctaatgttcctttcaaactttcatgacgcaatagtaaagcttctttacataattctaatctttcatctaaaattttccagaaattatcaagtttatgattagctgataatccagcatccgctaaatttaaagtaacgactccctgattaaaacgtccataccacttatattcaccgttttcatctttccaaggcgataaaaagcttcgacatcccatgcatggaaatacttgtccttcataattttctctcataactttagccgaaataaaatcaggcatcatacgcttagaaacacatttaaccgctaaatcagtcaaataacgatattcactatcttgagggacattattatcatctaacacatatagcagcttaggaaaagctggtgttacataagctccgactggatttttcatcccaacatagcgttgacgtaatgtttcttcaataagcattgctgtttctttgatatattctggttcttctcttaaatacataaatactgacaaaaatggtgcttggccattagtagtagaaaatgtattaatttgatactgaattgtttggattcctgcctttatttcgtcttttaatcttgtattagcaattttttctacttgctcatctgtatagttgattccaattaaatgtccttcatgacgaacattacgctgatgtttttcataacttaatctaacatatggtgatagatgggctagcgagatcgtctgaccaccatattgaccattagccacctgctgaacgatttgtgttgccactgtacatgctgtttgtaatgattttggtgtttcgatcaatttatcattgatcactgttccatgagcaaacatatcttttaagtttactaaatcacaattatgcattttttgaatgtaataatccatatcatgaaaatgaatgattccatcatcatgagcttgtacgatttttggaggcaaaagtagtctacgacaataatctttagaaaattcaccagcaatcaaatctctttgcgttgctaaaacagttgcatctttattagaattttcttccattgcctctttattagtttgatttacgattccgtaaatttcattatcaattgtattagtttcacgttgaaattctcttactttgcgataaccttcatacgctttagcagttaaaatctgacctttttcgatcaatttttcaaaaacttgtccttcaatacgataaattgaaatattacttccatcatatttatgccaatcttctatttctactgcaatatcatgagcacatttttcatcaacgatgccacttccacatttcattgcttttaatatcgcattttcaatcttttcagcatcaaactcaactttttttccatctctttttactactttcatactacttcttccctcctaaaaattctatatccatcgtatcaaaaaatatctaaatataaaaataatatgcaccattactagcatcttatcttcaaacaattactaattataaccgaaatcacaacgaatttcttcaattttagaaaattagtaaataaaaatttaaacctgttcattcttcaataatttacaatgttgctttttcctaaaacagtcaaatatctatttaaaccaacgaaagagattttaacaattatatctaaataaatcaatatttagataatcttaagttcttttaagaaagcttttattttattaattcattatcatgttaaaattaaaacatgaaaaaaattatcgttatctgtttaatattactttgtggctgtacaaatgctagtgttaaaatacagcaaataaaaaataaagatttatttgataaatttaatatttctaattaccaaaatattatgatcgtagcacatcctgatgatgaaacaatttggggaggtggccaccttttacaagacgattatcttgtaatttgcttaactaacggaaataatcagattcgtgctaaagaattcgagaaagttatggaccaaagtcataatactgggatcattcttgattatcctgataaaactaatggtaaacgtgataactggaaaacagtttatcatgaaattgaagctgatttaaattacatattagctaatcattccttttctacgatcgttacccataatccccgaggtgaatacggccatgagcatcataaaatgactagtactatcgttgcaaatatcgttaaaaatttaaaaatcactaataatctatcttattttggtcgttactataaaaaaagcaatcctattttaccaatgaaacatacttatgatgataatttattaacacaaaagaatcagctgatttctaattatcgctctcagaagaaagtatgtgataatctaagtcatatgtttccatatgaaaattggatcagttataatgactggtattaaagtatattttttaattaatatctttttaaatgtataaaaagtctaaactattaattcttagtatatgctaggtataataatatttagacttttttattgaagtaatttgtttacatcaaaccaattatctagaaattttaatgaaaataggattttgttgcactctatatttttatttaattccttaacacgttttctaattgtcttatgtgattatttttcgataaaaaacatcataaaatctaattcttttcttctacacttaaatcctaataatctattattatacaatatcattaaaaaaagaaattaattatattacagcaaccatttatcaagcctaaattacctgccaaaaacacattaagctatacgattttgaatagatgactttaaatatcttattatctcaccaaagtacatataatttatcactatttaaaacagtacttttccataattaattaaataatgtttaatagcattatcatctttatttattgcttgtaactattctataactaaaatataaaaattattcttttctattaaaattttatataatagttcaacaatataaaagctatatgaataatatatccaaaaattggttattttacataatttcaataagagaaaattaaatttataaataatctttgtactatttaattaaaaaagagtgctattttataacactcaataataataattacgattatatgtaggatatttacgctttaaaatcacataaacaacaatcaacacgacacctattacaccacaaactaagcctgaaaaatgtaaactatcgacggggatatcaatactcatacctaataacctcattccaatagtgaattccatggcattaactactaaaggtaagaataagccaatgattattcctgaactcaatgaactgatcccgctacataaagtccatttaaaatatgatttattaattacccctaataatacaataataactattaaactaattatgcaaactactctagtaaaagtatcgcttaaagtactatatgttttaataaactgttttgttcctggggtagctgtctgaatcttctctactgtgctttttatcttattttgtaatgtactgtcttcatcagctaatttagtttgaattttatctatttgctcttgaggaatttcttttccgattgcttcttcgatttcaggaatacttttatctagagcatctgataattgtgataaaatttcatccatcttcacttcactgccattatttattgattctgtaatctgatctaataaatcaccagtaacattatttaatgtatcattatttttgattacatcttcaactttatcaatagtttcattactaacatctggaaatgtactatttaaaatttctttaattccggtgcttgcttcttgaacaacaactgcattagttactgtttttgtcgacatcgttcgaattgataaatttacacacaatattatagttacccccaccataataactgttaaaagtatatttaaaaattttttcattttatatacctccatatcctctagtatattatagttccttttatcctctaagtcaaaaaaaggatttctctttaattatattcctgtttacgattactatccttaacaatataaataggtcgtgctttattttccatatagtctttagacacatactctcctaatatagcaattaatagcatttgtgtcccgcttagaaacaaaattaaacaaactattgttgtataaccactaacactatttccaaataataaagttgatatggcggtataaagagataaaattattgatccaataaatagaaatactccaaaaactcctgctaattttagtggtgctgtagaaaaagaaaacattccttctaaagcataagaaaataaacttttaaaattccactttgtacatcccgcagctctttcgacattattaaagggaatccatttagtttcaaaaccaacataagaaaatagacctttcatataacgattatattccctgatttttaaaatcgaatttaccatcaatctactcatcattctaaaatcaccagcaccatctgacatatccaattttgacaaacgctgcataactttataaaaagatttacttaaaaaattacgtaaagcaccttctccttcgcgatccatccgttttccagcacagcaatcatatccttcttgactaacggcttgatacattggagctaataatttaggcggatgttgaagatcagcatccataataacacaataatcacctacagatttttccagccctgcaaacattgccgcctcttttccaaaattacgagaaaaagaatagtaattacaatgatcatctatcgcacaaatatctttcaataaactgatcgtatgatcactactgccatcatcaataaataagatttcataatcaacattttcgattttttccaactctttagttacttcttgatgaaataatggtaagacctcttcttcattataacaaggaacaataacactaattttgtccatattcatgatctcctctcacagcaaaaatactaaatttgcataaactatagtttgaaataacagtaattatactaacgacgattttagagagcatctcattagctcccaatagctggatgaacccaaacaataagacactttcaacaattaatgttcctaaacgcatcgcaaaaaaatgatatgcttcccttcctgcttcattaacacttttaaaaacaaaacgtttattggcccaaaatgcaaaaatcactgccccgatccatgaaacaacatttgcaatcaaccagttttgatcaatgatcttaataacggaccaataaataacaaaattaaccatggtcgtacaaccacctacaaacacataactaatcaattcttttaactcttttttcatcctgccatctcccttgaaaaactaataaaataattcctaaacaacttattaaaaggccagcatttttcatcggagcattaaatataattgtaacttgatgttttcctttagatatttttgcccctaaaaaagccttattaacgcattcattttttacttctttaccatcaattaatattttataaccatcttgataaacaaatgaggttacaagatagccatcttcttttacatcgatcatgccttttgcaagcgtatttctttgattatattcacctttaaaagcatcaatttcctgattacggttttttataacatcataatcgattacatgaatctttatattagataagtcatatcgtccttttgaaaattcaatcgctaatttatctaatctttcattttgacttaatacatatgtaaaatgattattatgattagggtatggagcactcgttgctgataatttatttttgatgccattgatcgtaatacttgtatccgtattttttatcaatttcactttctttaaatcaaattcaataattaaaatcttattttctaaattctgctcaagatttaataccagctcagattttttctttgtatttatacgataaccattatctaacttaattatccctaaatcatcacttttattattaattgttgtttttaaatcaattgactctactttactttgataatcacttcgatcagtttttacaattgtgttattataaatcgtatctagtgtttttggaaaagttaatttatcaaactcatcttcactataaatatcactcgaagcatatattaacggtaatacatcattattttgatacacatgattttctatttcttgataaccaataggaacgatcgtttcactatatattgtttttactgccatcagtccttgaaaaaatatatttgaattagataaacacgcaactctatttcggatacttatcggattattaataatatcataataaaattggttatatcgcgaattactgattgaactataaatagaggttctaaaaatattatcttttacctgatttacggtatttaaagactctttaaaaatatctgttcgactatcattatcatatttaagatcatttattttagagacctgttgatatgtcttagttgtaacaaaattttctgtctgattatcaaaataacttataataaggggaaatgtcattaataacaaaactgtagattttgtaaattttaaatataataacaaagctatcatacatgctgccatatccaaaacaactaacggctgttgataaattgttgctactggtaaaagtaataaaataatcatcttgaaatccagctttattgaattttgtttaaaatattgtaatacataaatagttaaatatattattaaaggaattaagggtattaagatctttgctctgggatataaaaaaccatttaaaacaaatgaaaaaacgggaataaacaaaagtaataatagccagatacttaaataacgaacttttttgatttttaatcccaatatcaatcctatccaggcaaaatatccaagtccacatccataatgatcatacaataatgattcaaaattaaatcttggaatcaataaactccatatatttattgacgtattgttgctttgatgattttcaagcattacatatgcggtaggcaacagtaaaacagcacaaatcattattcctattattaagggtctgataaagaaaaatacttctttaaaacttaattttctttcaagtcttatcatttcaaaacaataataactaaaaatcactaataaagcagcaatactaaaaaaataactatttgtaattattcctacaactgccacgatcaacagacttactttctttttttcaatatatatatcaactgctattaacgctaaaatcaacattgccatataatcaacaaacattatttggcgatgactttgaaaaagcaaagaagaagatagtaatgtaactgcaccagttaaacataaccaaatattaaattgcttacgttttaaccagtaatagcataaattaacacttaaaactatattaattaacatataggtaattattatatctttcatttctactgacggtaatagacaactaattaatacatctattctgaataaaccatagtaagataaattataaatattttgtccagcaccaatgttaaaagcaaaatcaggaaaaatagttttgttttctaacatcacatttctaatgtaatcagccagattaacatgttgcgaaagccaatctgtatttgaaccaaagatacttaaagaaggcataataaaataaactatcattatagttaaacatgttaaaaatataaatggataaacatttcttcttttcattactatcattctcctgcttagtattatctatcatattccttaagaacagcctaaagaacatctaaatatttcttaatttttggtttattaatttcttaataatcaatataatgtataataaatacgaaagttggtgaatatatgataaataataaaattttaattgctgatgataatcctgagattcgagaagttctaaatgtacttttatctagtgaaggttatgaagttatcgaagctaaagatggtcaagaagtaattaacttaattgatgctgatattgatttatatattcttgatattatgatgcctgttataaatggttatcaagcatgtatcgaaattcgtaaaaaatcaaatgctcctattttgtttttaacagctaaaactcaagaaagtgacaaaacccttggtttttctagtggtggcgatgattatctttcaaaacccttttcttacaatgaactaacaacaagggttaaagcattactaagaagatattatatctatcaaggaaaagttgataaatataatatgactgaaaataaaatcatatacaacaatatagttattgatcctaataacgaaaccgtatttctagataataaacaaatcgaattaacatatatcgaatatcaaattctgtatctacttttaagtaatcgcaaacatatatactctacccaagctctttatgaaaaaatttggaatgaaccatattactacagtgctaataatactatcatggtccatattcgtaatttgcgaaaaaagatcgaaagtgaccctcaaaatcctaaaataattaaaactatttggggtaaaggttatcgctgtgattaagcatttttttaataaacttagtgttcaaataagtgctgtaattattttattaggtacccttgcaatcgttgtattttgtttgttgtatatggcaagagaaaatttttttgaattcactcaggatttgggaattatttctgaaaatactgaagcttatgcaatcaatattgaaaatcaactaattgataataatgtatcaatcaatgatgttgaagaaatagacaaaattattggtactagtgagatttatagtgtaaatctttataataaagctgataatcttgctataacgggatcttttgcaactatgcttgataatttatttattggttatactgtttatgacactgatatcatctatgatggtgatgaatatcatactgatattcaattaaaagatggtaatgttgaaatgtatgtgtattcttatgcaatcgcaaaacttgttatcccttatcttgtattttcaattatcattgccttatcaatatttttaattcctacatatttatttataaaacgaaaagttcattatattgagaatttaaaaaatgatgtcacatatatgtctcaaggggatcttaatcatccaattttgataaatagtaatgatgaaattggtgagctgtctgagcaaatcaataatcttcgtctaatcttaaaagataattttgctactgaggaagcaaatcgtaaagctaattatgagcttgtaacagctctgtctcatgatattcgaacaccattaacatcattgatgggatatttagatattatcagacttaaaaaatacagaaatgatgaacagtataatttatatcttaataattcaatcgataaagttaatcagatcaatgaactggcaaataaaatgtttgagtattttcttgtttttagtaaagaacaagatacagaattaacaaagatgtctttaggtgtgatttatgaatacatgattgaaaatatcgatgtattaaatgaacatggttttattattgaaaaaagtttagaaccaagagatgcatttattcgtggtaacattaatttgattaaaagaattattaataatattttttcaaatctgttaaaatatgccgaaatcaatcagcctgtttatataaaaatgatcactgatgaaaataatttaaaactagtatttaaaaatcaaaagaaaaatacgactaattatattgaaagtaatcaaatcggattaaaaagtgtccagcaaatgttaaagatccatgatggttcttttatggttgttgatgatgaaaatacttttaatgttacgattacaattcctttgatgaaataattagtgtataatgatgatatattttaattgaggtgaacatatgcaaacaatcgcaaaatttgaaaaagtatcagttaaacagtttttaaatgattttaaagacagttttcctgagtatcatgaaacaacaataaatgaaatttatgattcattgacattgccaaaaagagctacagtaggctcagccggatatgatttttatactccaatcgattttatcttaaaacctaatgaaactatcaaaattcctactggaattagagtttctattaatgaaggctggtttttagcaatcttcccaagaagtggtttaggctttaaataccgtttacaattaaacaacactgtcgggataattgacagtgactactattatagtgataatgaaggtcatatttttattaaaattactaatgatagtaatgaaaataaaacggtggaaataaaaaaaggacaaggatttgcccaaggaatatttatgccttttggtatttgtgaagatgatgatactgatcaacagcgtaatggtggcttcggttcaacaactaaataatgtaacagtacaatttaagtactgttttttattataaacaaaaatggatagacttctctaaatcaacccacttttatttctttaaatattcatcaataaatgtataaatttcttttgatcttgaacgagcaatttcaaaggtcttatatgttttattagttttaaccacgatttgataatgattatatcttaatatatgttttaaattaacgatactatcacgattaaccataatgaaacatgaatttaatttcttataaatatcttttaatgtcttttccattaatcgctcttctttattggtaaatatatatattttccgatcaagcattttaatatatttaatatttttttgtttaaataaagtaatattatttccagctgttttcaaactaacatattctctaataagaagcttgaaacaatctttaatatctttaagcaataatttatcaatatcttttatgtcaataaaatcataaacattaagaaaataagaattgtatcttttatatttatcattagaaacaaaaataataattatttctttattaaaaaaataaagttctttagcaatactatttccaggataactagtatcatctaaatcaattattactatttcataattcttttttttatctactaattcatctaatttagctgtcttgataatacgatattcataattttctttaaataattcttttgaaataaactcataaagaaaattatttctctgttttgataatatcgcaatatttatcattctaaatgttcctctcccatattttaaacatcatttttctctttttaaacacctaattatataaaccgtagaaattataatataatatgagtaacttacaagtgacaaatgtcacataattattaaaaatttcaacattattatttactaatatcaattgtaaaaatagtgcttatttatacttagaaagagggattctaatgattaaattagataatataaaaattaagtataataacaatgttattatcaaacaaggaagcatctcattgtttaatggtgaaattacttgtattagcggtaaatccggttgtggtaaaacatcattattatatttgatcggcttacttacaacagaacaaaattattcttattatctcgatgatcaattgatcaatcttcacgataataagaaaattgaattaatcagacaaaataaaataggtttcattttacaagataatacgattcttgaagatttatcagtgattgataacatcttttttcataataatgataataaattagctaatgagttattatcatattttgatcttataactaaaaaagatgtttatcctaaaaatttatcaactggtgaaaaaagacgtttatcaatatgtattgccttagctaaagaaccagcaattcttattggtgatgaaataactgcttcactagatcctgaacaaaaaaataatgtttttcaaaagttaaaacattatgctttagaaaataacatttgtgttgttcttgcttcccatgatgatgtgatcatcaataattgtaatcatctttatgaaattagaaatcaagaaattattgaattaagacatgtttcattatcaaaaccagctgtttcaaaaagtaaagatcatgtctacaatctaaaaaaatatttaaaagcatatcagaaaaaacattattttaactatcttatttccacctttttgattgctatagcattattaatgtgcagtgctattacctcaacctttcatgccatcgaaactgatttcaaccaaacttttgatactttatcacctaaaaaaattggtatcattaaattaaatgaagaagagcttaaaaatcgtgaagaatcgccacaatcttatgaaaatgatattccctacattagagaatcatggacaacgttaaccgataaagagattcaagctattgaagaccttgaaaacgttgaagatatttatccttattatgaattggaatatcgtattggtactgtctatataaataagaaatcatttatttttccagaaaatacccttatttctttacaaccatattatcaaaatgaaagcagttatgattatcgagatgatggtatatatataagtcaaaggtttgccgacgattttaatattaaagttaatgatactatcaaaattcctttaacagtaggatttgctcaaaatattgacctttctatagaaaaagttatcttggaaacaaaagtaattggaattaaaaaagacgatactacgattgtcagtaggagtgaaaattcagaacttgtattagcattaaacccttattatttaaaaatcagtgataaacaattttatgatctgtatcaacagcttaccccgacattaccaccgacaggatcttatattatttttgcaaccaaaaatgaatatgttcctatagttattgaaaacctaaagaaaacctttaatgaaagtgaaatatcttatacttatccaatttataaagaaatggaaacaatgaaacaaaaccaattaggtactgaatacttagtggaaattactgtcagtgtaatgattattgggttattgactcttattaaatatattcaattaaaaaatcgtcaaaacgaattaaatatgttaagagtcaatggtatttctaataaaaaaataatatcagctttttgtcaggaatcactgattcaaagtttaaaagtactagcaataacaatgatcatctatatttttatttctttaccaaatctatttttagagattaaatttcctaatctattaatagagttatctttatatgctcgtctatcaacatatgatctaataattctaattatagtcgctattctttcctttaccgctccgacatatcttgttcttcgcacaatcttgaaaaaagatattacaacattattaagggaaacttatgattaaaattgaaaatattgatcttgcttatgaccagacattgatcaaagatggtcgattattattaaatgaaggacaaattactgtgcttagcggaaatagcggctgtggtaaaaccacattactatacttagttggcttaattaatactaattggcaatgtgattattatttctatgataaaaaaattaatttacgagctgagcagaataacagtttattaagaagatattatattagtaatattctccaagaatttgatttacttgatgatcttagaatagatgaagcacttaaatcattatctttattagcaaaccaaaaatacgatcctgatgaaattacaaatttacttttacaacttgatctcgatataaacttaaatactcttataaaaaatctttctactgggcaaaaacaacgtcttaatcttttatttgccctaataaaaaaaccaaaattattaattcttgatgaaccaacaagtgctcttgataaagaaaatactaaactttttatcaagattctaaaagaaatcacaattaaaaataatttaattgtagttattgccagtcatgatcaacagataatcgataatggtgatgtagtttaccaaattcaagatcaacaattaaaatatcttaatcatgttaatgaagtcccctctactttaagttatcagaatggatcaattattccctttttaaaaaattacattattaatcacttaaaaagtaaacaatgtatgatccttttacttacaattacattgattattaatatttgtataattttccaaacatattttgaatccatacaaaataaacagttagaaaatattattttaatgggcggtaatgagtgtcttttaacaaaatcagataattctaaaataaataattctgaattattaaaatttaagaaacagtatcgttatttaaaagcttatccctatactaaaataaaaacaacgctcgaagataataccaccgttactttgattccctattttcctgaacaagatagatttactgatggtttctacgccatatctaaagtatatgataaaatgaaggataaaaaatttttcacagttaatgtctataacaaaacaattgttattaacagtttaaaaaattatcaattttcccaagataaaatcatttatatagattataaacttattaatgaatatttgacagatagtcaatatctgcttatcttttcaacccccgaagatgtcttaactttttgtaataatacctcttatacatcctcgccagtattaaataatttagatagtttaatgcatcattatcatagtactggtatttatttaaatttgattttaggtttaatttatgccctttcaacagtattatcatacattattcagtttcaactgctttatcacactcaaaaaagattaactttatttaaagtacacggtttatcaattaaacaatctaatttaatccatataattattttatttttacaatatttatcaattaccataatatcattatttattttgtctttctttactaaccttttaaattcattattaaaaatttgtatttgtcttatcattacaataataattccccatatttttataatttataaattgactaataaaaaaataatagccacaataagaaactaaaaagactcatttcgagtcttttattaattatttacaaactgtgaattatatagtttttcatacaccccctgtttagctaataattcctcatgcgttccttgttctacaatatcgccattgttgattactaaaattaaatccgcactttttatcgttgataaacgatgagcgataacaaaacttgttctacctttcataactgtttgcattgcctcttgtagcattttttctaagcgagtatctactgatgaggttgcctcatctaaaattaaaatttgaggatcttttaaaatagctcgcgcaatcgtcaataactgtttttcaccttgagaaatgttatttgcttcttcattaatatatgcattataaccatcaggtaaagttcgaataaaatgatggacattcgccattttagctgcttggattatttcatctttacgggcatctaaacgaccatagcgaatattatcataaatagttcccgaatataaccaagtatcttgcaacaccattccaaacattgcacgcagttcatttcgtggtaaatctcgtatatcaataccatcaatcttgatactaccgcctttaacatcataaaaacgtaataatagattgataatcgttgttttaccagcaccggttggaccaacaattgctaccatttgtcctttttttatttgaacatttaaatctttcatcaaattttcttcataataaccaaattgaacatgttcaaaacttacatttccctgtacttgatcaagatgcttaggcaaatcagcctctggtacttcttcattttcatcaagtaattcaataactcttcctaaagcggcaaaagcggattgaatttgtgatgataaactagaaatctgtgataagggatcattgatttgccaaatataacgaataaatgcttgtaattgcccaacttgaaatgttcctgtaattacctcaatcgttccaactacagctattgctccgatagctaaatatgtaactaatgaatttagtggggcaatagttgatgaaacaaattgtgctttaaaagcatttgctttcaagttttcattaatactttcaaatttttcaatcgattctatttgttgattatataatagaatttcattataccccgtatacatttctgttatcgcactatttaattcacctaaagcatcctgttgattcttaaataatttttgactttttccaactattaattttgttactaatagcgataaaggaataatcatcgttccaatcaatgccattttaaaattaagcatatacatcatactcaacgctaaaataagcgttaatatcccactgacaatttgtgtaaaactttgttgtaaggcattcgaaatagcatcgatatcatttgtaatccgacttaaaacatcaccataatgatgattatcaaaatatcttactggtaatttacgaattttattttgtaaagcattacgaagatcttccattgtatgttgaattgcattagttaaaaatactgctgatatcatttgtgaaacagtcttgataatgtaaatgattgctagagtgatgattattttaataattatatcaaaactaattgttatatttgtcaagttactgcttttagctacatcactagctaattgcgttgttatttttccttcaaaagatggagctaaagcaatcgaaatattaaaagcaaaaatcattatgattgcaatagcgaattgccatttatagggtctaataaatggtaagagcccttttaaactctttttcaaactatatttattattcataatttaattcctcctcacttaattgagaagttgcaatctcatagtaaatttgacactcttttaataattgatgatgtgttccttgaccaactactttaccttcatttaaaacaataatttgatcagcatccataatactggaaattctctgagccacaactaacatgatcgattcactcatttcttttttcaattcttttcttaaaaccgcatccgttttaaaatccaaagccgaaaaggaatcatcaaaaatataaatttgggcttttctcactaatgctctagcaatacttaaacgttgcttttgtcctcctgaaacattagtagcaccttcacttataagctcattaaaaccattttctttgtccataataaatgaataagcctgagctactttagctgcatgaataacttcctcatcagtagcatcttttttaccaaagcgaatattatctgcaatactaccactaaaaagtactgctttttgaggaatcactcctaatttatcacgtagttgtaaaacatcataatctcggatatctttttcattaatttttatccttcctttacttacatcataaaatcttggaattaagttaactaacgtacttttacctgaacctgtactgccaataaatgccactacttctccctttttagctttaaaagacacatcatataatacaggttcctctccatcaggatatgcaaaagtaacatgatcaaattcaatacttacttcatcattagacttatcatcaacaggatcattttttattgacggctccaaattaaatacttcttgaatccgttttgctgatacttcagctcgtggatacatcataaaaactgtacaaaaaagcataattgaaaacatcgcatgaaataaataatccataaaagcaacaagctgaccgatttctaaagaaccactagaaatcagatgtgctgctacccaatatattgacatccccgcaatattcatcagcataaagaaaattggctgggtcataatcataattttaaataatttctttgaatatttagtgaaatgataattagtttccacaaaacgtttttgttcatacgaatcattgttaaatgccctaattaccctgattccactaagattttctctagaaatgcgatttaaatcatctaatgaacgctgttgattttcagaaataggtttagttattttcgcaactaaaaaaactcctaaaataatgataggaatcgttgcagcaataatatacgataaacgaagcgatgcttgagctgtcataataaaactaaaaatgaacataattggcgtcattagtgccgttctaagtaatacatttacgaactgctgtatttgaaatgcatcgttattcgttcttgtaatcattgaagatgttcctatttgattaaattcattagctgtaaattgttgtacttttttaaaaatatcatttctaatatcacgtgtaattgaagttgaaattttagcacagcaatatcctaaagcaatagttccacccacaccgataaaagaaactaaagcaatgcagccacccatcatatagataaagcttgtgtctttattagtaactccaatatctatcattgttgctacaatggtcggaattcctaattcaactaaaacaaatccaaaaactgaaaccacgttaaaaaagaacagtaatttatagttttttaaatattttaagattaatttcatttctttctcctttcattgtattgtgaagcaactaatttaatgataaactataaggtaaccttatagtcaaggaggattagtaaatgaaagagaaattattaagttgtggtacttttgctaaaatatgtggtgttgaaaaacatgttttatttcattatgataaaataaatctttttaagcccatctatgttaatgataaaggatatcgctattattcatatcgtcaatacgacacttttaaagtaatcatagctttaaaaacgcttggaatgtctttaaaggacattcagatctaccttgataaacgtactcctgaattatttttagaactattgaaacagcaggaaaataaattaatcgaatatattaatgaaatgcagcatattcatgagttgattaaaagttaccaaacatttactactgatgctttaaattcaaactgtaatgaaattaaagttgaatattttgaggagactaaattattattatcagcaaatttagaaaactccaattctaaaaattttgcttcatttatgcatgattatacaacctttattgaaaatcatcacataataactggtgaatttgttggtttgatgatgaaactagataatattcgtaataataatcttaataactattcttatctttttactactacaaataatccttcgcaacaagtttttgttaaaaaggctggttattatttatgtggatatcatcgcggtagtgaagataagttatatgatttatatttacaaatgttacaatacgctaaaaacaatggtattaagttaggtgaatttgcatttgaagagtatattatttctgatatttgtgaaagatctaaagataattatttaactagaattacaattgaaataatcactacaaaaaataaatgattcaatatataaaaagctgtaactttaaacaataaaatcacagctttttatctttttcattattttttctttgatcacgcggaataaaaactcttatctcttcctcattatatccaactagaaaatgatgttcatccaatacgatcggtctctttaatactgaaggattagttttgataaaatcaattaagtcattcattttcatactattaagatccagcttagttcctttaataattttactatttttagaaataatgtcatctgtaccattttcacatctttctaatatttctcttatttcaaaaacatgcaaatctgatgaaaagatatttttttcaataaaacttaaattatgctcttttaaccatttaacgacgttacgtcctgagcgactgcctggagctgtatatactcttatcataatttcctccactttaaaataaggactataattagtccttaatatcttttcaatttatatgtttatttctttacccgtaatgttatgatatattcatcgtcatcttcttcagtttcactgatgacttcaattcctgatttttgaatcaactcagttgcttggttaattgtattaattgctattttaaagttttgtgagaccgccttaagaggtcctttttttgttttggttttattttttggtggtttattaactaataactcagtttgtttaacatttaatgatttctttattacttcttgtaatacgctatgctgtttttcttcatctaaggaaagcattgctcgggcatgacgttcagtaatttgttttgtctttagtgcttctttgacatcatctgataactttaatagtcttaatttattagcaatcgttgattgttttttccctactttgtttgccagttctgtttgattcatattgtatgtatcaatcaaagttttataagcttttgcttcttcaattggcgaaagattttcacgttggatattttcaattattgcgtatgtatcgacttgtttatcatctatatctttaatgatgcagggtatggtttttaagccagctaatttacatgctcgaaaacgtcgttcaccagctattatttgataatttcgattatatttacggacaataataggttgaatcaaaccattttccttaattgaagtagctaattcttcgattttttcatcatcaaatactttacgaggttggttttcatttgcctctattttatttatatcaatttgtttatataccttctctaacatattctctcctataatggttgtttttttattttagcgaacatccgaggaaatttattaggtgttgtttttactttctttataattatattactacgatgatcattattagttaatgtaaaatcgacaatttcttctacactgccacctaaaatatcaattcctcttttcgcttcttgtaactcttcatctgccttaagtccttttaacgctaaaaaatatcctcctactttgactagcggtaaacataattcatctaaaatattcaatcttgctactgctctagccattacgatatcacatttttcccgattatctttggcataatcttcagctctaacactgattgctttacaatcagttaatgctaattctttaaataaatgatttaaaaatgtaattctttttgtcaatgaatcaacgatcgtgattttcaaatcaggataaatgatttttaaaggaatacttggaaatccagctccagcaccaacatcaacaatactttgattattaaatttaaaatcaaaagcaattgttactgaatcataaaaatgttttaaataaacaccctcttcatcagttattgctgttaagttcattttttcgttccaatctactaatatcttataatatgactcaaattgtttgatctgtttattatttagaacaattcctttattttccaataattttataaaatcctctttagacatatcctactcctcattatatttttgttttaagtatatcaataaaactgaaatatcagcaggatttattcccgaaattcttgatgcctgcccaatcgttaaaggacgaatcatacttaatttttgtttagcctctaatgctagattacttacatcttcataattaatatcatcaggaattctcttttcttccattttcttttgtttagctgcttgacgcatagccttatcaatatatcctttatatttaattaaaatcgtaactctttttgtttgctcttcacttaattttggtccttcaacaaacggtaaaattttctgataatcaagttcaggacgtttaatcagctctttagcactgattccttctgtcaatcttgttgaacctaactgttctaaaacttcattgatcggatgttttggtgtaaaccgaatcgtatcaaggcgatcgatttcatcaaaaatacctttcattttatctaaatattcttgatatacttcattattaactaaacctacatcgtgtccatacttcatcaaacgctgatcagcattatcatgccggatcaatagacgatattcagcacgacttgttaacattcgatatggttcctcagttcctttagtaaccagatcatcgatcattaccccaatataagcttcatcccgttttaaaattaaaggctccttatgttgattctttaatgttgcattaattccagcaatcaatccctgtcctgccgcttcttcataaccacttgtaccattaatttgaccagcagtatataaattcttaattatttttgtttccagtgatggccataattgtaaaggatcgattgcatcatattctattgcatatgcatattttaaaattttacagttttctaaccctggtatagttctaatcatctcttcttgaacatcatgaggtaatgaagttgaaaatccttgaacataaattgtattcatttctttagattctggttctaaaaatatttgatgttgtggtttatctgaaaatttaacgactttatcttcaatcgaaggacaataacgtggtcctacaccactgacataaccgccatacatacttgagcgatgtaaattatcatttattatctgatgtgttttttcattagtatatgttaaataacatggtaactgctcttcaataggaacaaactctttggtttgataactaaaagccaattttgcatcagttcctggttgtaaactcgtttttgaataatcaacgctattgatttctactcgtggtggtgttcctgtttttaaacgctgaattcgaaaacctaattcttttaatcgtgttgataaaaatttagattctttttgctgatcaggaccactagcatgtttttgatcaccacataatatttcagctcttaaatatgttcctgttgtaagaataactatttttccagcaatttttgacccatccgctaaaataacaccttttacataatcattttcaacaattaaatcttcaaccatagcttctaaaatatctaaatttttctgttgttttaatacctcttgcatatatcgaggataagcctgcttatctgcctgagctcttagtgactgtacccccggtccttttgcagtatttaacattttcatttgtaaatatgttttatcagcacttttacccatttgaccacctaaggcatctatttcgcgaacaattatgcccttggctggcccgccgatcgaagtattacaaggaaggcttcccacattattaaaattagatgtcactaataatgttttttgattcattctagctggtgctaatgctgcctcaattccagcatgtccgcctcctaccactataatatcatacatttatattccctccttaatcgttatctattgtactacaaattttgtcttttttaaacaattatcaacttagattagtaaatcataaaattatctaataagtattattccccttcataaaaatatttaaatcaatttcttttcacaaaaaaagaagaaatttaattcatttcttctcactattaattactgttcttcaactacctcatctacattatcaactacttcttctaattgatcatctttttcttctactggttcatcatcactttcttctgtcagatcatcttctctttcttctactaattgatcattatcttcaattatttcattttcaataatttcttcttttatttgcttaggatttaataaatttattacttttccaaagaataaaaaagaaaatgcataaaataaataactaactgagttgccaataaaatatgaaataatatctgttagatcctcactccaagaaacacttccctgtaaaacaaaagaattaatatagtcatatgaattcttcatagtaaacaacgcatataccaataaaagaatagccagcaaataacatattaaagtaaataccggtttataaaaccaattttttatttttttcatttaatcaatatcctttctttaataactattatcataattaaaaattatcgaataatcatgtgataaattatgaatactatggttacacattttaaaaaaacaaaagcagcgtttttacaactctgcctttatcaaaaacttatatttatttaaatatatataatcaattatatataagatctttacttccaaaagttctttccactaccaactgaaataattttaaattgcgtatcgtttgaagttccaccagtaaaatacttaccagcttctgttccattaaagatatcgattttattacctttaatagcaccaccacgatcaacaactattccatatgcagttgactcaatacttaaattatgattagagatttcaataatagttccaaaaggaatcgaaggatcagctgccaaacaataatacgaacgcccattataagttagttttgggctattagaaccttgtactccagtaattggacttaatttgattcctgttgatgaagttccatttccacctgcacagtcaccaccatatgttgttaatctacctgtaaaatatgccccaggttgaactgtacctgtttcaattattgtatctgttgctggtactataactgtactctcaattaattctttgccaacttctttaccattttgataagttacacggtacgtattttttacttgtccttcttgcccatgttgtgtaactttagtagtaaacaattctaatccatttgtatttacagtatttgatttaatcgaatctatttcatctacatttgcttcattaattcttgtaatttgaactaaatcaccattatttaatacataactcatatcataatttaatgaatcttggggattcaaagtaatttttaaatcttcaaggactgttgacaatgcagcttgtctaactagataatccttttgtgcttcatcaccatcttgaacttttacatcaatagtttcaacatagttatcaatttggtttgttgctccagcatttaaagttgttgcaacaattccaatataggcaatcatcactaccaagatccctttcattctaggatttgttttaataatagcctctttaatttttttcattaattttcctcctatttaataccaaaaatttttttggcattaaacgttgtcatacttgcaacgttttctatctccatgttctttagcttagctatttcctgggcaatatacacaacatttgcaggctcatttaacttacccctaaatggatgaggtgttaaataaggacagtcagtttcaattaataaattctctatgctaatattcgctgccacatcttttggaactctggcattcttaaatgtcactggacccgctagagagatataaaatccaagttctataaatctttccgccatttctacagaaccactataacaatgcattattccatgatgtccatttcgttttaacacttcgtaagtatcttcataagcatctcgacaatgaataatcaccggcttatgatgctttttagctagatccatttgccactgaaaaactttcatctgttgttctttagtaacagtatcccaataataatccagaccaatttcaccaagtgctactacgcaaggttcttctaagtacttatcgattatgtctatttgtttttttgttgtgtttgagcaatcgtttggcccaatgccaactgctgcatatataaattcatactgtttagctaattcgattgcaatttgagacgactttaaatcgtagcctacaacaaccatattatcaacgttgttatctaaggcgttttgaataaacatatcgtgattttcatataaatcgtcactgtttaaatgacaatgagtatcaaagtacataaatttcacctccgctgtatattaacaaaatcaaatacatttgtcaaatatctaaaagcatttttaactttggatgataaaataatatgtaaatatcgatatttttttattaatgtattctttttaatacatttttttacatacaaatttagacaaaagataaatttattaaaataaagatagaacttttgtaaagaaaagaagaaaatcattaaaatgatttcacatacaaatctttgacaaaataattatttttatactaatttaaataaataaaaaggagcaaacactcctttctgttatgaagtgacctttgtcaagtgaaaattacacattcataataaaattatttaattttatcatcaatggcatacaaaagccccaaaatactagatttatcgacagttaaccactctgttatacggagattggctactccaaggttaatggttcgtcaaataagttctaactatctatatacgtgaatcatctataatttatgatattccagatcgcgacttcttttatatcttatttatgccacaaagaaaggaccgtagataactaaacctgcttctccttttttgaggcttttctatgccattgattttgtgttctttttttctcgatttttgtcctccatttcttattttttctttaaattttcataattgtatagaaaacatctttttacatcttctatattcttcctgtttccattccccatataaatcctgctagttcccttgccactgccatgatagctacattatatggtttccctcttaataccatccttctaaatcttttttgtaatctttctactgccttatctgcatatgctacgatttcatcctcctgtcctttttgtctttttttcaacgcttttgatttctttccaactgttcctcttactaatgcctgtgtacattctaccagtgtctttctaaccatcgcattccccatcttggtgattggtgtattgctgtatttctccgcgctcgaattctctcctggaagcattcccagattcgccataaatgcctttgctgttggaaatcgctgaaaatcactcactgtgacatgtatcttcattgctgataatgtatctattcctttgaaacaggaaattttagaaaccggttccttatattcctcttcttttgaaaactcttctatcctttcatcatatttttcaatacgttcatttaaataatcatagacttttaaatattcatttaatgtttctcttacgattactggcaattctatcgtttcaagccatttgatatgggccactgtccagttgcttttcccctcatatcttaatcctcgtctcaataccaatgcactgatctgctgtttgattctctttcttgactggatgacatcttctcttagacctatatattccttgatttcattgtcatgttctgttggtacatgaacagctttgtatgaatcgtgcataagattagtggcaatattaaaggcatccatcttatcattttttacttttttatttttgactgatccatgcattgttgatggtgctaatataacacatggaatatcatggtatgcaagttcatgatataaggaaaatcctaaacatccagcttcatatcctgttaaaatatccacctcattttcttcactcattctttctttagctgacttaataaatttaagaatattctttacttcagcagcacattttgtctgtgcaataacttctcctgttgatgaattgattccacataaactgtacgtatttttatggacatccatcccaatataaattatacttttcatagtgacctcctattgtcgttatggtatcgactttcataattttgtttttttactaatcttattatgaatcgtaatccactttttgacaacttaggaggtcacttcatattatctataatttcttctcaatttcatcaacaaaagatttcgtaatgacctgtggtcttgttattattgatccaaccaccacactataacatcctaactctagagcacgtctagcttttaaaggcgtatttaagtttccttcaccaataactggatgtttaacttctttaataatttctctcataatttcaaaatcatttgcttcgattttatcccctttactttgaggtgtataaccaactaaagttgttcctataaaatcaaaaccaattttatcagcatgaatagcctctgctatcgtagagcaatcagccataaacatttgctgaggatatttattttttactttctcaaaaaattcatcgatcgattcattattcaaacgcttagaaaaagtagcatccatagcaatgatatctactccttcttttactaaatcatcgacttctttcatcgttggcgtaatataaactgaagttcctggataatctttttttataatccctataattggtaaatctactacttttttaatttcatgaatatcactaatactattagctctaattcctttagcaccacccattttagcagctaatgccatttttgacataataaaagatgaatgtaacggttcattttctaaagcttggcaagaaactattaaactatctttgatttctttcatatttcctcctaatttctattattaccttaataattataatctataaacaatatctctactaccataaagttcttaaattttttctttactataaacccttttatctttattagtattattgaaaaaatattttatatcatccaggtcaatagctttttgttattatccttaagaattgttcatcactgctagtcatgtcatgcttatatttaattataataatgtttttgatattcttattatttccatcttctatataaaatctctaattacttaaactaataatatatttaaattctatgatatcccttatataaaagtccggcaaagacggcacaaagtgttgccccaacaaacattataatcaaataaattatctctccagcacttacaatcaacatactataactaatagccaatattgaaattagcatacctattataccacctaaagttaatgccccaaagcctcttagaagtcttttttgaggcaagatcctatccaatcggcaaatacgttcagttactaattcgacaattcctactaacataagtatagcaggaataacagatataagcacgatttttgttattatttcatcctgcatgaaattcggctttttcacaaagcaaagagttaaaccaataaaataactgatccatccgatattcccaggaatgtcataaacaatccatttaatgttagtaatcgttgtttcatataaattattatcgatcataaaaacttccctcatttctttatattttattatatcatggtaaatactaaatcatttattaagttttatttttttatatagaaaaaggcacttatttatagcgcctatcctataaaaatattatatagttattggtaatttagaacgattttttgtccgttatgatcaataactgtcaaatcatagtcatataataattttaatgattctgatgtgatcgtcttattgggatctccctgaaatattattttaccgtttttcatagcaacgatttcatcgctataattaatggcttgattaatatcatgatgaaccataattattgtcatttgatatttagtattaatttcttttattaaatttagaatttcaatctgatacttaacatctaaatatgtagttggttcatctagtaataatattggtgttttttgtgctaaagccatcgcaatccaaacgcgctgctgttgacctccagaaagtttagcgagaaggcgattttcgtatttttttagatttgttgtttctaaagcccaatctatcatttgataatctttttcatttaaactttgatgataatttagatatggcagacgcccataaccaacaattgttttgacatctaaatctccataaatttgattcttttgatggacaacagctacttttttagcaaaatcttttattttataatcccatatatttttattatctaataatattgttccactttttactttgtaaatccgactcaacaacattaataacgttgatttaccactaccattaggaccaataattgaagtgattttatttttaggaaaactaatcgataagtcttcgataaacgcattgttttgataactaaatttaatatttttaacttccatcaatatcaatactccgtttcaataaaataataaataacggtcccccaactattgccataattattgctgatgaaatttcatacggtgccataattacccttcctaatgtatctgctacaagtaaaataattgcacccattaataaacaaacaggaattaaatgcttatgttcattccctaccaataaacgtgaaatatgaggaactaataaaccaataaaaccaattaccccaactattgcaacactaatactgcataataataccgcaattagcgataatccaaaacgatatagatcaacattgattcctaatgacattaaggttctatcttcgagacctaacaaattacaagcctttgccataaataaagttattacaattaccggtactaaatatatcaataatacgcgaacatcattccatgtgtaaagcgaaatagttcccatggcaccacttgttatagaagccgttgaactttgtgctaaagtaactaatgcactaattgtataattgatagcaacaccaatcaaaataattcgtgttgtcttaaatccagctttccatgataaactgtatattatcgcaaatgttataagtcccccaaagaatgataatagtggaattacagcatataactgtggcaaaaatataccagctagaatgcttactaaacttgcgccattagaaatgccaattatcccaggatctgcaaggggattttttaaaaccacctgaaacaacaaacctgataaagctaatgccccaccaactagcattgcaataatgattcgcggaaaacgaatgctataaatactagcaacattttcattatattcaacaaatagacctttaaataattctagaaatgatacttgaatgctgccaacatttatggcaacaaaaaaacataaaaacaaaataacgatcaagataatcataaataatttaggatgttttttaattagttccatacaaaattccttctaacatttctaaacctttttggtaattaaaatttgcactcatcccaaaataattattatctaaatcataaactttattattttgaacagcactaaatttactccaaatatcattttcttgaaactcttttttaaaactttccatcacctgctcaggcattgcatgactagttcttaaaataatatccgggttttgttgcagcatatcttcagcattgacattaataaaatcttgtccatcaccatcaccataaatatttgtagctccggctaatctaactaaatcaccgacataactagattccgttgcaacaacataacttcctcctggaagtcccattaaaatcaatactcgaggacttacattatttgaatatttttctctaaatgaaaccatgtaatcaacaaattcatttactattttttcagcatttttttctttatctaaaagcttccctaattcttcaatacttttaaacattcctgataagttttttagatttaaaaaagaagaactaataccaattttttcatatttagctgctaaatcaccttccaaagaattaggacttaaaatcaagtctggttttaatgttgataaaatctcaacatctggtgtcatcgctgtacctaactcagttgcattctgatacttttcaggtacactatatgcttcagtagttggaattccaactacctgactagcaggaacctctaatttttcaagaatttccgtaacagctactgatgttgcggcaatcgttaattcttcacttttactacttgaaccgctttgatcaacacaacctatcaatacagctgcaattatagctatcagaagactactttttaatttttttaacataataaaaacctcctccagctataattattaaaacaatgatgataccaccaataattaaagctaaactactattagattcattactttcactgctatttgcattctttaaattttctaccgtcagctctttcttattatcaactttaccattttcatcaattatataattagaaagaccagaaacattttctaataaagtttccttcgttactgttcctactgttgttactggagcagtttctggtatttcttctactggtgtatctgtaacagtattattttgactgctatttgaatctgtatttttattagaacttgtaccaggatctgtattagctacactgccattttgcgtatttgtattagctggaatcatttgactagtatacacaccagttcctggagtagctgaagctggattaagttcaataaaaaattggacatcccgccccattggatcaacatacataataggacttatatatacatttaaagaacttatctgaatccgataatgattgaccgtatcaccattagcactactgctccctgttttagtagctgcaacatcactaaatgtaccactgctgttcatgattttaaatcttacatttgacacatttgaagccaatccaagaccaatcgttatataatattttccacctgtttgttctaataacaaattactttcaacgatactagaaaccatgctatcacctaatgctatattggttccaccatcttcggttttaccagttagaggattaacataagacgtggagcgtccaattaagtacgctccatcgtccaaggcaaaagctggttgaggaataattaccattgtaaaaatggtaactaataccaaaactagtttttttatttgcataatctttttctaattacatatccagcaatggcaagtgacgaaactaataatcctccaattaattccacatttgcattatcaccagtctttactactgcatcgttaccacttgtttctggtgttgttgtattattacctgtactagttgatccatttgtttctggtgcttttggggcatcaatttgatcagaaacatattttaatgttgagtaatcaactttcattcttgcagcaatatcagcattccccataatttcaacatgaggattaacaactacatcaaaatattcttcttcacttggtaattcaaatgaccacaagatcggattaccagcagcatctttagcttctattttagcaggatttgatttataatcgccattaatagacccaatatacaattcctgtaaactagctttgatcgtacctaaagtcatttctttagttgtaatatacattgtagctacaccattttttacaactactgttgcttctttatctaacgcactagctgccattgatgcttgatctctatctgcattccacaaagcaacatcaactgtgtaagttccatctttagcaaatttacttgattcaacagggctaactaatgttggattttctaaatctaaagataatcttgcttcagctccgcgattacttccaccataataaaattttacgtttgttaattttgtatttctagctaatgtaaattgtaactcactaacatttccatcactatcatgtcctgtaatatcagcttctttataagttccatcagcttgttcaacttccattttatcaatgtaagcagtttgaccatatacactaacagcccccatttgtaatgttactaagatagtaccattttttgaagtcacaacagcacttttaacagcttgtgcagccattgattgttcatcactgttaatttttaatacatcactagcaacagtataagtaccatcagctaaagtatattcaggttcttctggctctggttctggagtaacatctgtaatgttctcaacatctaatgataatgtaacttctgttggatagctagaaccactacccattaaataatccataaaatctacagtaagtgtaatgacttgtttagcttcagagtctaaatttaaaggtagtttaataacatttggtacttctgtatttgtatcaacaggagctaatgtaatattatacccatcattatcttttccaggttcagatgataattcttgcttagttgaaataactgttgctccttcaactgttttgatatttgcatggaattttgacattccccaagtactcatatctacgatcatatgttgtaaagtgatagtggcaacttgatttccttcatcatccactgtaacaacgatactgtcaccaaaggctttagcaaaagcatcttgtacaggttgtaatggtgctttactaactaaacttttcactggtacttcatatgtacctggttgtgataaatctactttagcagcattgacattgcttaatgctgccacttgaattccaaatgccatcattaatgcaagtactgctttaaatatttttttcatcgttttcctcccttttattttttgttagaaccatctaactatatttttaaaaaaaaattaaacctctagttaggcggtactaacttacattaatcattttacatatatccacattttaaacaagcacttattttgttgctacccccacaacaaagtaactgtattttcttaattttacctttaattcaaatagtttatgccatgtttcaataatgaaatattattttaaaattattgttaaaatggcgacactttcaggcatatgaatcattcctacattcgatttaacttttattttaacacttgtttgtaagattctttcctctttcgaataataaaaatataatttagatattggaataacaaaattatccattattacttgcgaagcaatatatttttgctcagtttcatactttaaagattcaactttcccttttaagaccatttttcccatcaacgattcatgttcaacttcttttggttgtaatataagattgccatgtcccatttttatttccaagatgccaggatgtacaaagccatcattagccatcgaaattccaagtttatctgctttataaatagtaaaagcaaacggatattccccgtcatcaagatttgcacttaacatatcaccactaatttctttaactttatcaatcaatttaaataatttttctttacttgaattactaacaagcttagcacgtgattctggtgataacgtcaagactaaagttaaagcttcttgataagcttcttcatcattaaaactagaagtatttttaagccaatctctaagtttattaatatcattaagataacctctagctaatttacatccctgacacgataatacccctttacctttttcattgattaaaccttcttgataaaagttattcaaaacgcggctaaacgtcgatttagaaacaccaacttctttagccatcctcgttacagtataattcatgtccttttgtttatataaaaataataagtatgtcaatttttccttcgatatttgcatattttccccttatctataagttacaaaaaagttagttacaactaacaatcataacattttttactattttttcaatcaaaatcttcattattctaaaataaagtgataacgctattaagcattatcactaacaattaatttttctttattttaaaactaaatactgtcaaagcacctaatgccataatagccaatatcacaactggtaaatcatctccagttacaacactttccatcttatctataacatcattttctttaataccattattaacattattatcgttaaaatcatttggtttttcttgataatcataggttaataaagaaccatcataaccacctaaattcatatctttgtaatctccatcatttgattttgtctctaataagatagaaacttgataattattaagagcgatgatcttatgagcatattcagcttctgaacctccgattgtttgtaaagaagttcgctttccatctaatgaatatgtagcaacaaaagcatctctacttcctttgtttaaattttcaaaatcaaaatctgttccgcgactgtcacctaataaataatactgctgatttatttccgtgacacttattccttcactgttttcagtacttttaataacatctttccattcaacttcgccagtatcgttacacttgataataaatgcattatcatatcctgttcccttgttttcaaaagttcctgttgttgatttagtgttacctgtcatgacaaatccgccatcggctgtcgcaagcaaattatttccatactcatttttttcaccaccataagttttaagccaaagcaaattgccagcactacttatttttgccacaaaaagatcaaataaatcaccatagtaatcaacatcagtaaaatcaccactacctgatgatgtaattccccctaataagatatcaccattagctaatacatctaaaccaaagccagcagattcaatatttctaccgcctattgttctttgccattcaacattgccatctttattatatttcacaactactaaatcaaataaccctttatttagctcctgcatatcaccgtcattggaattagtttctattaatactaaacaaccaccatcagctgtagctttaatatgtttagcttgatcatggtttgaaccactaaaccctttcatccaaatcaaattatgatcatagtcatatttagcaacaaatgtatctgtttgtccatgaattgaatcttttgtatttaactgttcaaaatcaccgtttggtactacatatgcaccatcaacataacttccagtaactacatacccatcattttgtacatcaatacttgacgcatatgcaatcgtatcccattcactgccaccaattgtatgaccagctatctttttacctgtagcatcaaattcataaataaacgcactggatgctcccttaagcatatttttaaaatcaatatcattagaatatgtctgtccaacaactaataaatgtccactaggtgtgactgccatatcagttgtaaaatcctcatcacttccacctaaattagttttccaagttacattaaaatcaggaactgtaacttctactggtgcaaaatatggtggtgtttcagttacttccattttatttttatcaaacgatagtctaatatctcccattgcatcttcaatatgaattaaaatcggtatatctaaactatccgcttttactgtcgttgtttttacttgcgttatcttatcatattgatcgttgatagctggataaaattcattttgatattgataagaaacagcacctaaggttgaagcactaacttgactgcccatgatattagcattaatgaaataaacggtaatttgataactgtcattcaccttttcaacataagcatctttataaagcattgctgccatcattgaaggagtatcatcatttgctttccaagcaactaccggaactagatatttttcattaatatctctttctatcatactacctgcaatacttaataaatagccatcatatttaccacttctattttcagtaaaaatattatcagttgaagatgtatttccacatactaaataatcatcgttgactcctgcaataatagaattaacagtatctttatcattaccaccaaaagaggcaatattcattcgttttccttcttttgaataatatgcgacaaaaacatcctgtttaccataactagttactccagtaaaatctaaatcattattactaagtgttcctgttatcatatatccctcactagttgcaatgatatcttcaccagttgctgcttcactattttctaatgtatctgcccattctggattaccatcttcatcaatttttaagatatacgaattattagttccattagttgatccaaacgtcccatctatcgaatttgttgtaccgactaatacataaccattatttttgataacttgattatcacgatctgtatttcctctatcacttaaagctggataaacactatttacaatatcatccttactaccaccataagtctttacccattgcttatttccatgttcatcaaatttaactacaaaggcatcttttccgcctaaactaatttcagctaaatctccatcttcagcattagaaaaacctacagctaaaaaaccaccatcgttgcatgttattactttagaaaattcatcttgtttttttactgctgcacttccgccagttccaccagctgtttttacccattgaatatttaaattttggtcatatttaacaataacagcatcacgatctatttcatttttacttgtatcagctaaatcaccatctactgaatgagtatatccaactgttacatatccaccatcataagtattaactacatcttttaattcatccgaatcactgccaccaaaggtagtgattttttcaacattgccatcatcatcaaacttagcaataacaccatctttaccgcccttgttcaaatcgagcatttccccatcattggattgacttacacccacagttacatatccaccatgattagatgccgtaacagcattaaaactatcagctttactaccaccaatttgcttttcccattgtaaatttcccttactgtcatacagcattaatgctccatcactttttctttcatttactttgtttccatcaaatgtcccagctgcaataattttattatcaactaaattttcaatatcgttgatactatcatacgatccagcaatcgttgatgacccactacttccgtaagtagttacccaattaatttccttgtctttttctaacgcttgaaggggataacttactaacgacgttaccacagataagcttaaaactaacgataatttatttaatttcattttttcctcctcttacactcagttagctatatctaactaattatctttaacttatcacatagtctcatccttaacaagatatatttatgtttcatacctgaaacaaatttaataaattcactatattattcaataaatttatacctaagtgtaaagaaatttgtattcgctttcattaataacgattatataattcttttagaaaaattagaggtgagcgttttgaaaacagaaaaattattaattgaaactcaaaaatattatatggcaatcgtttttaaagactcattattatctccttttgcttgtagtatcgatgaacctgtcatacttactgaactaactgccatcactgttgctgcgactactgacaaggcttttactcccacgccttttttcatgttttttcctttacaattttctatctgtaattattgtactaagtaagacaatattctaaaagggtcacatatgtttgcaataatcaaatttgcaccttgtcatttttaattaaaattaaagtactaaatatatttttcttcttattctatagtcttttatattataaagctaaaaatcgatatctttcactcccttttacaacactatacataaagttctctacacagtgcttcatttgtaacattttaatgtgctcataaactttcatcacttagtcttatatcgtgatatataaaaaatttagttacaatcaacaatcataacatttttatctttttcaattaaaatctctattattctaaaaatagtgacaatactattaaacttcattacccaaaaatataatatctaagctattttccacttttgaataataaataacaaaacactatacttattataactagttgctactatctataatatttttaaataaattcttatttttcctaaatataatgttataaaaaacaaatttgatagaaatatgctataataaattatatataatattaagagaacaaggagtagatagtatgattaaaattaataatttaacaaacaatgacaatattcgtattgtagataaaaaagaaggaatcatgattattgaatatattaaagatttaagtgtaacagaagctacagccataaatgcttattatgcttcaaaaatgaatgttcataaacggcaagttttaattaccttaaataatgattcatatacaatttcacaaggcgcaatgcaatggatggctggaaatgttaaagctagcgctgatgtaaaaggggtaggtgatttttttggaaaagctcttaaaggtgcagttacaaaagaatctgcagtaaaacctcgatatcaaggaactggatatttaatgcttgagccaacttttaaatatttatttattgaagatgtaagtaattggcaaggtggcttagttttagatgatggattatttttagcttgtcaatcccaagtaaatcaaaaaataaaatctcgttctaacctatctagtgctgttttgggaaatgaaggtcttttcaacttgatgctttcaggcaatggtttagctgttttagaaagtcctgtccctcgtgaagaattaattgaaattgaattacaagatgatgaaattagaattgatggtaactatgcaattgcatggtctggaaatcttgaatttaaagttgaaaaatctactaagaatcttgtcggttcagctgtttctggtgaaggatttgtaaatgtttatcgtggaactggtaaagtactaatggcaccattagcgtaatttaacaggctataacacataagttatgtgctatagccctttttatattatctaactttaataaaaaagcgggaaatacccactaataaaacatctactagctaaaggaattctaccggtttacagaaaatacaaactacctgtcaaactaaaaactggcgtatactttaaccatataaatgtagtttcaagactacatcttttcagcttgtacaaattaaaaaccagaaaacatatctatacgatatgacttctggtttaaaaatatattttatatctatttatcaaaatcaaacatttggaatacatcagaaactggtaaacagttttcaatattttcaatagttttagcaagtaatcccgctacagaaactgtctttaatttagggaatattttttcttcaggcaatttaatcgtatctgttacaacgacttcatcagcagaagagttttgtagtctttctacagctggtcctgaaaatactggatgtgtacaagccacataaacagacttagcacctttttcctttaacatttcaattccagcaacaattgttccgcctgtatcaatcatatcatcgaccatgatacaatttttacctgatacatctcctaaaactcccattatttcagctacatttggtttaggtcttcttttatcaatgattgctactggagcatctaaagcaaccgctaatttacgagcccttgtagccccaccatgatcaggagaaactatacaaatatcttccaaattttttttcttaaaataatttgaaattaatggcaacgcctgcatttcatcaacaggaatatcaaagaacccttgaatttgagcagcgtgtaaatcaactgtaacaactctcgtaactcctgccacagttaataaatcagctactagtttagaagtaatcggttgtcttggtttagctttacgatcttgacgagcatatccaaaataaggaataattgctgtaatttccctagctgaagctctttttaaagcatcagttaaaactagtatttccattaaattttcagtaactggattagaagtagactgaacgataaaaacatcttttccacgaactgattcatcaatttcaactaaaatttcaccatctgcaaaatgatgcaccttactttttcctactttagttcctaattcttctgcaatatcattagctaattgaccactagctgacaatgcaaagacagttattttatttttcatttttttctcctattttcctttttgatttcttttttcttccaatactttagcatatccatctttattaacttgacgcgcacgagcaatagcaaacgcatcatcttcaacctgatcagtaatagttgaacctgcagctatatatgcattatcgcctattgttactggtgctattaaattactattacatccaataaaagcattattacctataactgtttgaaatttattttttccatcataatttgaagtaattgttccacaacccatattaacattacttccaactgtagcatcaccaacatatgttaagtgtgatgctttgctgccttttccaaaaacagctttcttcatttcaacaaagttacccatatgagcattttctaaaatatgacaatttgttctcaatcgtgcaaatggtccaatatcaacaccattttcaataattgaatcagaaataacagaaaatttgatttctacattatccttaacttctacatttgtaaattcacagtatggaccaatatgacaatttgctccaatacttgattttcctttgataatacatcctggttcaatagttgtattaggagcaatagtaacatctacaccaatataagtattgtcgatatcaataatattaacgccatttaataaatgttttttatttacctttaattgtaatgtttttgtggcttcagctagctccacccggtcattgattccacctacctcagctaaatcaggaatcttataaccaccaacttttagattatcatcattcataattccaatgacatctgtaatataatactcattttgagcattatcattagttattttttctaatgcttcaaatagagcaatattgtcaaaacaatattcaccacaattcatttcactgatcttaatttgctcaggactacaatccttgaattcaacaattcctttaacttgatcatttactctaattactcgaccaaattttttgtctaaatcacaatcacaagtcatgatcgttccttttaattgattatcattatgataagcaattaaatcttttaatgtttcgcttgtaattaatggtgcatctccatttagtactactgttgttcctggtctattagccaatgcttctttacattgcattaaagcatgcccagttcccaattgttctctttgatagataatatttacatcatctaacaatttttcaacttcttcagccttatgacctacaattacatagatttcatcgatcccaacatgtctaagttcatctacaatatgattgatcattggcttatataaaacttcatggacaactttaggtttgtccgatttcattctggttcctttaccagccgccatcactaccgcataagttttcatcttaacacctctttaacaacaacataataacaaaaaatcctcattaattaaagaaaaaaaagataaaaaagcttataatacaaaaagaaatcacttaaatgatttctttttcattcaatatttctgtttttctcacaaaataatattttcctttaaaaaacttaaaccctttttctaatattatatcacttctagtaagtccaaaaacacatgatccactaccagacattaatgccccatcaaaccctatctctaacatttcttcttttatttttgcaatttcagggaccattttaatagaaggtgcttctaaagtgttttgtaaattatcaataactgcttgataatcattctcttcaattccctttatcattaaattacaatcttgatgacttattttatttaaattcaaactattaaatgatttttttgtagaaacaccttttcgtggtttaactaacagtactttacactcaaacggaacatctataaagcttaacttttcgccaatcccactaacaaacgctaatttttggtatatacaaaaaggaatatctgcaccaatttctttacctaaggctgccatttcttcattagttaaatttaaataaaacagtttattcatagcttttataacagctgccccatcagcacttcctcccgctaaaccagcctgagtaggaatatgtttatatacgtagatcttaactcctttttttattccataacgttctttgatcaatgacactgccttatacataatattacgctgatcagtaggcatgatcttactattagactcaatttcaattccttcttcaatagtattaatataaattaaatcatgtaaagtaattggtgccatgatcatttctaattcatgatacccatcttctctttttcttactacatctaacgctagatttatttttgcatatgcttttactttcattatttcacctgcttgtcggataaatttttcttgctactccccttgtatcgattcccccaactcctaaatgtttattagaagttttagcaacgattttttctaaatcaacataatttttaatacttgcattagcaatttgactaacaacaaagaccggatccaaggcatgaatatttttacggcttggactagaagcaaaattagctccactagctaataataattcatagtatgactgacatgcccctgcaaaaataatcaaactatctttatcatcttgatatagtctagccttgcgaatcgcttcgacaaaatcttttgtatgcaaataactatttatattttttcgatcaccgttttttttcattgcatcatgacctgtaataactaataaatctggcctgtgtttttctaaaagcggaataattttatctttgatttcatgttctttcatataatatccatatacatttatattaaattctttatatttagctaaacacatttccaaataatttttatcaccatcaatatgcaagacactgccttttaaacacggtttattctctactattatatcattcttttcactattaaaatcacttaattccaaatcactttcatcactatcagcaactaagcgatattctattcccgtcaaatagtaaatgccatctttaatatccgttattctaaaacaaatatctttaccatatttttttcggcaaacaatatcaccaatcttcatcaatatcaccaatatattatatgcattctaaactttatcggtgatatttttaaaatcatctaatgataactcctcgcatcttttattagtatcaattccacaatctaataatatttcataagcattatcatattcttgttttaaattgttaagtattgtttttctacgctgcttaaagcatatatttaatatattatataactttaaatttggatttttaattaatgaaatttttataattgcagaatcaatatgaggagctggtaaaaaaatatttttattgactgtaaataagtattcaatcttacccatatcttcgatcattaataataatggatttttatatttgctggtcatttttaacgctacttctttttgtaccataatgatcaattcatctattttatcattactaaaaataactttttcgattattgctgttgtaacataataaggcaaatttgcaaccaaatagacttgagaataatcttgttttaatttttcaataattggttctagctcttgtttaataaagtcaccaaaaattatttcaacattatcgacattcaaaaattcatcatacactggtttaaatctttcatctatttcaaaacagattacttttcctgcatgacgtgccaatatttgtgtcaaagcccctatccctggtcctacttcaattacagcgatactcttatttatattcgcttgagcaacaattttatttacaatatttgcatcaatcaaaaaattttgcccaaatttttttagagcatttaagttatacttatttaatatatattttgttgttgtaagagttgcaatatctttcattcgattcaccttaattttctagtttttttaatatttcatcttttgtgatcccaaccatatttaaacgtttgaataaagtcttaacatttccatatccaagattaaacaattcataaactaataatcttttttgtttattaccaataatatctaactctaaaaattctttccaggtaatactttgtctatcggcttcaaaactaaccatattctctaatgcagcaataacagcttcttttttagcttcagcaatccctaatttctttttacctgtagcatccttctttgatacaaatgcatgcttacaatttggtacagcggcttgaatttgatcacgaattttttttccagggtaatcaggatcggttaagataattattcctctatttttactggcttctttgatcaagtctaatgtttttttatctagtgctaacccatgtgtttcaattgtatctactacaaataactcttttaacaaagctgtatcagttttaccttcaactattactatttcttttatttttttcattattcctcccacacaactctaaccaagataattatggttatttataattataacctatttatcataaaataaaagatatgctttagctattttatgttgctttataaataatattaaattatgttgacagtaattgattattcttgtatcctatttcttgtaaattaataatttgctttaataaagctatagcttttacttgtttctgatttataaacaagcagctgtagctttttttatgaaaggagactttatgaatcaggaatataacaatatggctcataagccaatctttcctttattaatgaaaatggctataccaccaatgatatctatgttgattcaatcaatgtataacatcattgacagtatttttgtagctaaattaggtgaaaaagctttaacagcattatctcttgcatttcctttacaaaacttatcattagctttttctgttggtttaggcgttgccattaatgctttgattgcccaaaatttaggtgcaaacaataaaaaaagagcagataatatttgtgatcatgggatttttctatctttgatccattctttgattttcgtttttatcggtgtttttttgatgaaaccattctttttaatttttactaatgatttgactgtattgaattatgcaattacatatggcggaatcgtaattacctttacttttggctcgataattcatataactattgaaaaaatgtttcaggctaccggaaatatgttgattccgatgatattgcaaataattggggctgtagttaatatcattttagatcctattctcatttttggaatcaatggttttcttgaattaggtgttgccggagcagcaattgctactattattggtcaaatgagtgcctgtttattagcaatttttctatttagaaaaaaatctgctttaaaaatatattttaaaaattttaaaccagaatttcaaactatcaaagccatatattccattgccgttccttcaggagttatgactgctatgccttctatattggtggcattgctgaatagtcttttagctacagttagtcaaactgcgattgctttttttggtgtctattttaaattacaatcatttgtttatatgccagcaaatggattgattcagggaatgcgtccactaatcagttataattatggagcgcaatattttgaacgggttaaaaaaattattaaggtttcaatagtcgttgtttcagtaatattatgtagtggtgcttttatttttgtacttttccctaaattaattttatcgtggtttaatgcgactgattcgttaattagaattggggttattggattaagaatcttttcattaggttttattatctcgacttttggaatcgttatttctggagtatttgaatctttaggaatcggtaaatattcattgactatttcattgttaagacagcttgtgattactctacctctagcctatattttattatcactgataggcttaaatggcgtttggttatcatttgtaatatctgaatttattgccagtgttacagctatagtcttattaaaaaaacaattagcaaaatttaaatagactctgtcgagtcttttttattctaaataaaaagatgactatttatcatcttcgtattctttataatcaacatcaatgacatcgtcattacctcgctgatattcttcatgactataataagcttttcgtttttcttctgttttacgttgaaattctttattaaattcctctaaacgtttttgatataaatatctttttatcgatgaccagattactaatactgctataataatccaagtaattgggctagttaaaagatttaaaagtaaacttaatacaattataataatcaaaattactaatatagcataataaaatcccatgatctcagctccttaatttattaatatactacttaaattcaaataattccttaatattaatagcaaaaccatcagcaatcttttcaattgaccgcaaagaaatatttcttgttcctctttcaacatctgaaatatagttttttgataaaccacaacgaaaagctaattcctcttgagaaatattttgctttaaccgtatttctttaactcgataaccaaatctaatttcaattttatccatatcaatcattctccatctgaattaatcgtttagcctcttcacttatttttttaaaccgatgatgtaatccagacttactaatagtctgcccagtttcttcataataagcttccgttaactcctttaatgtcatttctggatattttctcctgatcaatgcaactgaacgcgtcttttcatcaagcatatcaagtcccataaacatttcaattatattaatatcatcgatctgtttattagcggtcgacaaggactttatttcattagctatatcacaattattccagcgattaactgtatttgacatatttcgatcaattctagtactttcaaaattcataactgattgactagcgcctattgcccttaaaaaatctccaattttttctgatgattttaaataaactacatacttattacgacgttttattatttttgcatttaattcaaaattattcattatcttagcaataaaacctgcaaactcttcttcattaaaactcatttctaaatgataattcgaagtttcaggattattaacacttccacatgataaaaatgctccagctaaatatgctctaatacaacattcttttgcaagaatacttttatcaggaattagattaaatcctaaaccatccattaatgataaatcgtctaaaatttctctagctttagtaacctttaatatatagacattatttttctttaatttcattttgcgtgaaaccaaaaactctatttgtgggttatattcttcctttaacattttatgaatcttagaagcaattttagcattttctgttctaatcgttaaagaaagaccataactcgatagtgataatgtaccattaattttgattactgcacacagcattgctttttgacaacatgattcaaaatcattaaaaactacttcttctttaacaattcgcgaaaaggatatcataataactcctaatgatcagcatctcgatgtaaacgatgtacttgataaaacttactataataatctgcaaaataatttgttaaagtaactgaacgatgttgtcctccggtacagccaataccaataattaaatgcattttaccttctctttcatactcttttaataaataatcaaataaatctgtcatcttcttgataaatacttttgtttcttctttttctataacataatcataaaccgctttatcatttccggttaatgtacgcaattcttctatataaaatggatttggtaaaaaacgaacatcaaataataaatcagcatctttaggcacaccatgtttatatccaaatgattcaaaagtaattctaaacggatctacttttccactactaaaatagtcttctaaaagattttgaaatctacttccttttaattttgtagtatcaattgataaattagctaatttagaaatcggctctgccaatcttctttcaaattcaattgcttctaataaagaagaagctttattagaaataagcaatggatgagatcgtctcgtttctttatatcttttaactaatacctcatcgtcacaatctaaaaatactactgataaatgaatccagtctaaattagataataatctaatcgcttttaatgcatcatctaggcttactgccatagcaaccctttgatatttagaatcatcttgtaccaattctgcaaactcagttaacaaagcaactgggtaattatcaatacaacgaaatgctaaattttcaaaacaagccattgccctagtttttccagcacctgacattcctgtaacaattacaatctctacttgatccatcatcttcacttcactttctataattattttatcaaatttacaacgataagtgtactttatttttagctttttctcaactactttgataaatattttaactattataattaaattaatttatctttttagcataattttaaaaattttaatagttgaactaattactttctatcataatttataaacataataaaattttatatatctaaaactttatgtactgctctttttaattctttaactctttcaagttcaaactccggattagctttaaaccatcttacatttaatggtgaaggatgtggtaaaacaaaagcttttttatcaaataaaatttgatcattgaatatcaaatctttaaaatcctgattagggaaaaattttttagcagcataacttccaataattatatataattcattttcaactaatgatatttcctgctttaaccatctatcactgcaacatttaggtggcaaacgatctccaccgctttttgctttaccaggataacaatgggctaaagatgtaagataaaaattttcagaatcataaaaagtctcttcatcaagatcataccactgtcttaatttctttccacttaaatcattaaagggttttaaggtgttatgcacatttaacgaaggtgcctgaccaatttgcattattttagcatttttatttccccaaaacactggacgtaattcatgctcgacttttttattacagatacgacactttaatatttcttcctttaatatgttaaatttatccactttatcactacctttgatttttataataacaaaatttttttataaataacagtattaataatgtaatagaaaaagcatgaaattaaattcatgcttttcttattgcatttttttatttatgtgctcttctttttttgtttgctgctaatactactgctgctaatgctaatcctgctactgagtatcctaagcttgcactatctcctgtcttgatacttgctgttgtatctcctgcttttactgcagtgtttgttacaccttcgtttactgatgtacttggtacttcagcttctactgctgcttctactaatccttcgattgcactgcttagtgcctctgctgcagcatttacttcttcttgtgttgcatttgcatttgccattgctgtatttgcattttctaatgctaagcttactgctgcccatgattctggactatagcttgctgcatttaatccgtttgctttattgatcaagtcatttaatgcatctttatttggtattaatcttaagcttaaatatgctcttattaatccatcatatgcttcatctacttcttcttggaaggcattttcatctgctaaaacgttatttgctgtttctaatgctgctgcaaatacttcccatgttgcttctgtatacaatgcttcatcttttccgtttaccatatttactagtgaacgtaatgctgctttatctcctttgataaagtctaacatttgaattgctgttgctaatcgatcaaatgatgcatctactgcttcttgactagctgcagcatctgctaacaatgcttttgcttcttctaatgctgcattgaattcatttgctactgctggtactacttttgctaattcttcttcacttacattgtttgctacttctactgcaattgataatgctactttatttactgttgatactgctgattttgctgaacttaagaattcatctaatcctgcatgttgtgtgaatgctccgatttctacttcaacaccgttttctactccgattttcttgaattgtgttgaatccatgattacattcaatacattgcgtgttgctttttgtaaatctcctaatggaagtgttactcctgttgctgctgcaattgatgctgatgatccacctggcatgatcaagtcatttccggcatgcattgagtttactggtgttgattgtcctccaccccagtctgtcatgatcaatccgttgaatccccattctcctcttgctaaatctgtacataaatcataatcatctgctgctggcattccattatttaagttgtatgatgtcatgattcctaatggatttgatgtttttactgctacttcaaatccttttaaatagatttctcttaatgctctttcactgattgtattatttactgcattacgattgttttcttggttatttcctgcatagtgtttgattgttacaccgataccttcatggctttgtacaccaattgttgttgctgcagctgttacaccagctaccaatggatcttctgaataatattcaaagttacgtccacataatggatttctatgaatgttcattcctggagctagccacattgttactcccatttctaccatttcttctccaattgcatttccaaattcttctgcaacatctttatcccagctttgtgcgattaatgttccgattgggaatgctgtacaatattgataatatgttgttccattttgtgtatagctttgtgtaatacggattcctgctggtccgtctgctaatacgatgtttggaattgttcttgtttcataatatctacctgttgtttctccagctgctccacgcactgagttactttgagctccaatgattggagtactgcttcctccccaaccaataccttcaacaatgtaagacatttcttcaatacttaaacttgctaagaattcttccatacttacttttccttgatatacatcaagtaatgttggattatccaatgttttttctactacaacgatattttcttcataaggttcaatcaattgacttggtgtagtattatttccacttggatttcttgtataacgaggatttgcttcttgatctactgcttcataatcactatctggatatacatatgttgttacgctttcatcatcgtattcagaagcattgttttctgtcttaatagcagctgcatttaatgtaaatctttctgcagcggcaatttcttctgcctctccatcatatgtatatggtgctgcatcactgtttgataaaatatcaatttcttcatcctgcaccatttgattactcaattgttctgttgtagctgtagtatctaatgtaatcactccagcaacacttgtgtttcttgaactgtttcctacacgcacaacataatctccagcttccataatataagcggctctatcttgtgaatatgaagacatttctgttgttttatatgatactgttaatgtttgtgattctccaggttttaattcatctgttttttcatatgctgctaattcttggtatggtttttctaattcaccatcaggagcagagaaatatacttcaactacttcttttccagaatattcagttccaacatttgttacccttacatcaactgtaacattttcagcatcaactgtaacatctgtcacatctaaattgaagtctgtatatgataaaccatatccaaattcatatgctggtgttacattaaatgtatcgaaatagcgatatcctacatagatatcatctgtgtaatcttcttgtgttatattaccatcattactgctgaatgtttcagatgatggataatcttcatagtttactgcccatgtatcagttaattttccagatggagaaacttcaccgttaagtactttaacaacagcatctccaccgcgcattcctgcttgtgacattaaaaataatgaatctaatccttcgatttcattaaagaattttgtatcaataactccacctacattcaataccacaatagcattttcaaagttagctgctactttttctaagttagctctttcaatatctgataattgataatcaccagttgtatttgttctatctctaccttcaccagaattacgtgcaattacataaactacggtatctgttccattgactttagcttcttcaatttgggcatctgtaatttctgtctcatctacaaatggagctccccacattccgccaccatttccaccgttttcatcaaaatatgtttcgtattcacttaaccagctttcagaagtaacattatatccagcatttttaaatccatcccatactgttactacagaacgctgattaacatctccagaaccagttccacctttaacagtagcaacagctcctttaccaaataaagcaatatttccactttttgccattggaagtacattgttttcattttctaataaaaccataccttgggtagctaaattcatagaaagttcagcatttctttcttcacgtgaagaaatactaccatcaattgtctttgcaaatgcaggtattgcactagttactgcaagtgccatagacattgaagtcgctaaaactcgtttacaagtctttttcatatattttctctctcctcctataattaatcgtaatatactgtcaaccagttataatgaatgcgcgcttttcattaaaaaaggcactagcaatacaaagcaaatataaaaagcaaaactttttataaatcttagtatagctaatgcctgccttaccagttacacactatatacaatctttacattattaatcatactctagaaagcgctttctgtcaattggcaaatattaaattttaggatttttttatccacaatttttacaaaattctcttgattttataatttaaatcatcattcaattctttaaaatattacaaattttaatataaaaagctatcttcatattataaatactcataactgaatgatagctcccgagtttcgaagcagttattatactatcatctatgccaagtccttatcctacatgggattcaggactttttttaatgtcaacattttgttctttttgtgttgtgtattgttatattttgtggtataatgttcttggaggttggtcgttatgtttcttaaagtcgctaaatttaaaaatggtcgttcctttctttctattgttgaaggctatcgcgaagatggaaaagtcaaacagcgtgttatcaaaaaaatcggttttctcgatgaactcgaaaaaaattatgaggatcctgttcagcatttcaagaatctcgctaaaaaaatgacagctgatgccaaggctgattctactttttctctttctatagatcttaacagttatattgataatggttataactgcctgaatgttggatatcttccttttaaatatatctacaatcagctcggcctcaacgatttctgcataaataagcaaaaaagactgaatatccagttttctctgaataaaaatcttgaacttcttgttttttcaagaatactttatccctcttcaaagaaatcgacattcgaaaacagaaatcttttctttgccccttttgataatggtattaccagagattccgtttatgactgtcttgactatttttatctctataaaaacgatatcctcaagctcctctgggacaaatcaaaagatttctatcaaagagactgctcaaaaagctattatgactgtacaaactactatttcgagattgaatacaatgatgatgatattattgatgaaaatggtgaaatcattgaaaaaggcatgagaaaacgcggtccagaaaaaaacaaaagacccgaccctattattgaaatgggacttttgatggattccagtggaattcccatgtcctatgatatttttccaggcaatgaatccgaaaaaacatcattaagacctatactgaaaaaaacaaaagctgattttggtatagaacgtaccatcgttgtagcagacaggggactgaatacatcagataatatattttatattgccggcttcaataatgatgaaaattcaaaaagagacggatatgtttatggacagtctgtaagaggagcagacaaggaatttaaaaagtgggtacttgatgaaaaagggtataaaacagatattattgatgaaaacaataaaaagattgcctttacacataaatcaagagtgtattccaaggaaatcaaaattacaagagacggcaaaagaaaagtaaaggtcaatgtatgtcaaaaacagatggtttatttttcattcaaatatctcatgaaacagcgaaacgacagaaacagaatgatcaaaaaagcaagagagatgatcaaaaatccagctggatacacaaaagcaacatcatacggtgctgctggatatatcagtaatatagaattcgatagaacaaccggtgaaatcaaaacagaaaaagaactctttttagatgaagaaaagataaaagaagaagaaaaatatgatggatattattccatcgtaacaagtgaaattgaactggatgactacgaaataagaaaaatatacagaggtctgacaaaaatagaagatactttcaaagtcagtaaaacaaatttcgaagcaagaccaacatttgtgtggacaaaagaacatatagaagggcattttctaacctgttttacagcacttgtcatgataagactcctagaaaaaagactgaattataaatattcggtagacagaataatagaaactgcaaaaaaatacaactgcataaacatagacaggaacatatatcagtttatatataatgacagcattataaaagacatatcagaagaatttgatattgatctcaataaaaaatacagaaaaagagatgaaataaaaaaattattaaaatattagaaaaaagagaaattacactacatcaaaagtaaaaaaacaaatcgggtgaactccttatatatcaaggggtttacccgattttatggcatttttacttctaaactcaagatacaatctttacattattaatcatactctagaaagcgctttctgtcaattggcaaatattaaattttaggatttttttatccacaatttttacaaaattctcttgattttataatttaaatcatcattcaattctttaaaatattacaaattttaatataaaaagctatcttcatattataaatactcataactgaatgatagcttttcatttattgtgagagaaaattatttaactattattaattagattcttttcttttcttatttgcaactaataccattgaagctaatgctaatcctgcaactggatatacaaagtttactgtatctcctgtattaattgcactttcttttccaccatcaacactagttgaaatatttggtttaattacttcagcaggtagagatggttttacttctaatccggcaatagctgcttctattgctgcttgtgcattagcaacttcagcttctgttgcttctggattatctaatactgcttgtacgttgcttaatgtttcttgcaatacattccatgattcagctgtataactagctgcatttaaaccttgggctttattaattaggtcatttaataagtctttatttggttttaatcttaagtctaagaaagcttttactaattctgtaaatacttcatcaacttcatcttgcattgcgttttcatcagctaatacatcatttgctttttctaatactggcaacattgcactccatgttgattcaatgtatttactttcatctaaaccattgatttgatctacttgtttttgtaatactgttttgtcacctttatagaattctaacatatgcattgcacttgctagacgatcaaatgcgttatttacttcttcctgagtagctttttcattgctgtaaactgctttagcattttctaatgcttcattgaattcagttactactgcaggcactacattttctaaatctgcagcttcagccatatcaatagctatagctaatgctgtcttattagctttatcaattaaaacaacttctacttcaacactatcatctggcattacaaatgtaccagtataaccattatctgtcgcgcttactgtaattgaagttccgtttactttaacatctgttaatacttttttactactaatatctgaaatattgatagttacaacttttcctgcttttgatgaatcaattacattaccttcactatcagtaaattcaacttttgcattgtcacctaaattatcgcttagactaatatcataagctttatcttctccgaaaattactacgatatcatgagctttatctacattttctaaaacgattgtatttgttccaggaacaaagtcagcaactggttcaccatctactgtcacagctacagttttataaccatcatttggtgctacttctaatgtaaagttttcaccatattcaacatcaaagtcacttgttactaaagaaccttcaccttcaactgtaacgttttgagttaagatcttactaaaatcaaagtaatcaacattagcaacatatgctttatttgcatcaacagaatcatttcctacaaatgtaaagtatacatcatgtaatcctacaaattgttcttgtacatcttctggaatatccactgttgttgtaacataattactccatccaccagtatgagtagtacctactgtaaatagtgcatcaccatctcgagaatctaagcgaacttcgatttcaccattttgacatccatcactattttgaacagaatatcttacttctaactgatttggtgctactgcaaagtctacatctctatatccaacccatgtagcctttttaactccaccaatgttaggaccgtcatttacaatactgctatgacttgtatcataagtttctgcttcaattttagctaaaccgtctctaatatttgaaatacgatttaaaatgttttgtaaagctgtatattgagcaacgatttcatcttgagtagcatcaggatcatcaactactgcttgtgctgctgcaataccatcatttaacaattgtttaacagcttcacctaaatttgtttgatctactgctttagcagattcaattactttacttaataaatctttatcaatagctgaataatcattagtataaccaattaattcaacttctgataatgtagttccaccttttagtgatagtttataatattggtatccatttgtaccatcactactaaatggacgagtatatctaccccattcaaattctacgttttctctacttgaaagttcagaccaagtttcaccatcatttgatccatataatacaaatgaatctggtgcatcagcttgttgatcttttgtagatgttaaagttaacatattaactttaactggtctaataaagctataatataaatcagtatcttcagtaaatgttgctgcattatttgaattattatcaaataaattagtaatattagtaattccttttccagcaactgtatctttatttacatttgtactgaaatcttcttgaacatttaaatttgcaactgttaaatcttcttgtgggtttggtaaatctgttccactagtaagtgaagttccttctccttcaattccccattctttattaggtgtagatcccatattaaatacgatttctccaccgttagttaatgtttctgaagaaatgaaacttgaattataagcttcaccattaacagtcattgattgaatataaacattatcatcactgttattatttgctgtaattgttagtgtcttaccattttctaaatgaattgttgcttcttcatataatggagaaccaattgcaaattcaccactacccatatttactgggaagaatcctaatgatgataatacttgccatccactcatttcaccattatcttcatcacctatataaccttgtccaaaatctgcaccaacataacatctatgtaatacatctcgaactaatgcttgtgttttccatggttgtttagcgtaattatacatatagataattccgtgtgatggttgattactatgaccatattgtcctagtttaacttcacgtgcttctctttgttcatgaataccaccaactccatcaacagcgttataaccattgtaagttccttttgttgtaaagatagtatccattctttctgctaatgcttcaggtccaccatatagattagctaaaccgtttccatcttgtggtactgtaacagtcatgttatatgcatctgtttcagtgtagtctccaccccagaatactggatcaaaactatctccacttgtccattcaccactagcatttttacctttaaaccatttttcagtaggatcgtctgatgatccatcaaataattttacgtagtttaatgctctattacgataataatctgcttcgtcttgataagtttgagctgcttcattatctcctgcttctaatgcttcatcagcaagtctttgagccatttgtgaaattccatagtcattgatatatccttccattgaccatgagaatccttcaccagttgaattagttgtatatcctctaaagatagaagttgttaattcagctctaccacctaaagtaagattttcaacattagcaacagcagcattctttaacgaagctttataggcatcttctaattcgaagtttgcacctttagcagctgcatcaccaaagataacatctgagctagttcctaccattgagttagtaccacctggtgcaacccatcttggaacccagccaccatcattgtaatgttcaactaaaccgtttaacatttcttcatatttagaaggtgttaataattggtatccagcccatgttgtatgatatgtatcccagaaaccattattgtaatataattcaccctctttaacttcattacttaccgtactcttatattcccatactggatcttcattagttccggtattttcagataataagtttggataagcaaacatacgatataaatttgaataaagagttactttttgttcatgagtagcacctttaacagtaatgacatctaatttgtcgttccattcttcacgtgcttcgttataaacatcatcatagtcttttccacctaattctaactctaagttctttttagcttgttcatagctgatgaaagaagttgcaactttcatttctacagtttcagcatcaccaaagtttagaattgcagaattttgattactatttccatagcgttcacttgtccactcagtatcaaattcaccatatacgtacatagttttcataccattactatttggatttgattgagcagtgaatgattttttatcatcatttaaagttacttttttatcacttccacggacagtgtctaaaattacattatgatatgttgcatcttcagtaaatgtaaatttagtagctgaaccatgcatagttggtgataattctaatttagaaccttgagcatttccttcattaaattctactgcataataatgagcttttgcagtttcgttttcatgtgagaaaacagctgctctttcactagcgtcaattgatcctgttccattaggatcgatactagtgttgatcatatattcccagtttccacgatctccaacccaataacttggttcatgacttactgtgatatgtttcaatgttctagttgttccattttgttgatatgtatataacttgttatcaccgctatttgttactggtgcccagaaattaaaaccatgaggcatcgttacaagtggagcagtcaatccacgagaaaaattagctgtatcgttagttcctcgtaagatatttacatattcagctaaattatcatcatcataatcttctaatgcttcttcaaagattttgatatcatctaaataatttttaaaatctacatcttcgtctgctttattgtctttgttgtcataagcaactaaaacttcagtaatcactttacctcttagacttggatattgacctaagcgtgctgtaattttattccattgattagttaataatgtacgtgaatcaccttgtccttgtggtgttaacaagtttccattagtatcatcaataccaacatcacttaaatatgttccatcagcaaattttaaatctaccgccatattcatttgagtccagttataatcatattcactatcaactaaacctgggaaaattaaataacttaaagcagtattttcaccaattgtaacatttaaatctttatataaaacattccatgagtgtgctgcttctgttcctaaatgagttcctgaaatttcaagagcaaattcatcatcccatcctgcgttagctttctgattccatgcttcagttggaccagttgaaattttagtaaccatagttggttcttgaacttcttctttttcttctccagtccctaataataaatcagcaaattgtgtcattcgaccgttacccttatttgcagttatctcaattttataatattgataagctgtaggattagaaatcattatttcttttgtttcataacgtttttcaaatgtttgatcactctgttgatctattactgtccatgtttcaccatcagttgaaccatagaaagtccatgtcttaggatcacgatctggagcatcattagcagatactaaagcataacggtctaatgtttttgcttcatcaaaagcaaattcaacatgtactggattttcagtacttggaacattatcattagttaaaaacttagttccactatcgctatcaaatagcttgatttttctttcagcatcattataatcattgcttccagtaacactgctaagtacgactgatcttgtaatatcacctttgattttttctgccggtacaaaacctttgatattttcactacctttagtttcatcaaccgtactttctaaaaagcctggttcatcattaaatgatgtgtgccaaagaatttggtcttgagttaattgatttcttttttctactgctaatacattaattggacatgcactgataacagttgaaacagtaatcaatccacttgcaagacatgaaaaaatttgtttctttttccctttcatattttcctccttctcttataactctttacgtattaactttaacacaatcgttatacagataaaagttgtaaaatttgtaacctttttttacaaaatttgtccattttaaattaatagcatttctattaatcaaatgtttttttaattttgaccattagtggtcccgctttttttatgatatcagaaacacccatttgaacaaccttttttcccttaaagcgttccatccctttaattgcaacatcattgactaatacaacacaagttgcttcttgaatatcttttgcagttaactcgttttctacaccagcacctccttgagtttcaatttttacatcgatccctaaattctttcctgccatcactaatgcctcggctgccatataagtatgtgctacaccagaaggacacgcagttacacctacagctttcattttttatacctccaattttataactctgtaaattcaatatctaaatcatcttctatttgaatttctttatcataatctgttatatctttattatccttcttcaaaaaatttaccattaacgcagttattaaagacccgactattatccctaaaatataacccagccagccttctacaactggtaatactattagtcctccccaaggagcatggttcaatactcccatcaaaaaaggaattatattccctatggctgccccaactacaatcgaaggaattactcgtaatggatcattagcagcaaaaggaattgctccttcagtaatccctacagcacccataataatagctgcttttccagcttctttttcctcagtattatatttttttggtgctagtaatgttgctattcccattccgatcggtggtgtacaaatagctacaccaacccctcccatcaaatatggcaaagtatctacctgtgtttgtgcaaacagcgttgcaactttattgacaggtcctcccatatcaaatgctgtcatagctcctaatatagctgctaaagggattttacccgcacgatttaatgtatttaaccaattagtcaaaccatccataagtaatgagataggagcaccaattacccaaacaataattcctccggtaatcaaagtcccaaataatggatataaaaatattgatcctaaagattttaaagaaataggcaattttattttctttaacgcctttactacatatccagcaataaatccagctactattccacctaaaaaacctgcaccgatttgatcagcaagatatgcacctatcatccctggtgccaatcctggtctatcagcgattgaatatgcgatgtagccacctaatactgatacaaataattgtaatcccgcatttccaatcttagccagatctcctaaccatcctatccttggtgtcgctgctccttcaggatttagcataactgctaaagaaaacaaaacacctcctgcaacaataaatggtatcatatgcgatgttcctgttaataaatgctttttgattgttgaaactttttctttgacttccattattatacctccaacccttcacataacaatttgtaaacctcttctttatcactggttgtcaattgattcctgaagtcatcatgcattagtttacgtgccaattttgataatatttgcatatgtaaattctcattattatctttaggaactgcaattaaaataacaatatttgctacttctttagttttttcgttccaaacaatctcattatttaatctcccaaagcaaactgctggttcaattacattattcgttcttccatgtggtaaaccaattttgtacccaatagctgttggagcaattctctctcgatttaatacatcttgataaaaatcgtatacccctgtaatttttttttgaccctttaatctttttactaatgttaaaatcgcttcatttttatcacatgtgtcaatatcaaaaactatgcattctttttgaataattgaactcactcttatatcaccttcctttcacagttcaataatatttgatacgcttcaagcaaatcattacattcagttaattgggatataacatctgtatttgtaatcattcttacccacgttattatggcaggtatgtgttcttttttgtctttacttgctaaaacaaatactaacttaattgtcttatttttgaattttattggctgtttatttatcaacaggctcatcgtgctttgtttgatcgcttcgttactttccccgtgtaataaagcaaaactttcatctgtcacagagtagaaaccaagatcttcaattcctgcaaatatctcatcaacatagtttttattgataagatctttttgtaataaaatgtcagtactagcgtagacagattcttgccagctcattttctgatctaccatttttatattttcgtatgtcaacaaatcacttagtttatttattttttttatggtcttcttttctaattgatttcctaactctttttgaataacatctagaactcttaagcgttgatcatctgttaaaaagtctaggtgttgattaattgaataataatgagcaagagttgtttttcttggtattcctttattcctcatattaataaaatcttgttgtgttaaaataggattaacacaaatcaactcaatatcaactggtaatttaactggagaagtagaaacaacataatcaatgtcactccatttttgataactatttattctatatgtaggtataatatctactattgttacttgaaattcattcattaatgtttcttttaacatcgtcgatgttccataaccgaatccacacactaataaaatatgtttatactcattatcttttattcttttcatactagcaataaaatgaattgcaagataagtgatttctgtatcattattaatttgatcaagtaattcgatttccttagttactgataaaactatttcaaatactttgatatcactatttgataaaatagaagtgatattatcattcagctttattccttgttttaatcgggtaatcaaagcagacatatgattcattaatccttcaaaaagaattttgtctttttcaaatggcaagtcaattttttctgacatgagtaaaataaattgtttagttattgtttctacctggatgatatccatagattgctcatatttaccatatttattggtatagtttaatagttgtactagaattttctgttcttttaatgttaactttttttgtataatattttctaattcatttattgatgcatcaaaaatcgttaattcaacagggtttatatttgttttttctaaaggatgcgttttattatttatgatgtaaaacaataaaattagaacattagcaacataccatttatatagttgatctgttaataaacattgcatactatctaatagctcgtctatccattttacaacatctcttaaactaataaaattaaaagatttattaataatttctaggattttctcttcaaatgcattaattaatactttattccctgcaactaaatctacatatttttcaaattcttcaatcgttaaattagtaatattaatctcatttccaattaatttaaaatattggttatattgaatattaatatgttttttcaataattgagtttctagtaaatccaaatctttttttaatgttgatctagaaacttggagttctgaagaaagtttatttaatttaacttgttgtggatctaaaagcaataataataaaattaaagatattcgattatcttgagtgtaaataaattcatcaccctgttcaaaatcatttaatgataatgtatctggaaataacaaacgaccttttggtaatttttgaattactggtaatttttgaatttctaaaaaatcattaattttttcaatatcataccgaattaatctttctttaatatctaatactttagaaacatctttaaaagttgtatctttttcgttgtaaagataatgtataattctcagcattctcccatttatcatttttattcctccctgcaccgcctcccttaattattatcataacgagaaaggcttttaatttgtagatagaagttttgtaagaatattttccaacatttaacacattagaacaatttacttaaatttttaatttatatgtcgtatttttattataagattattagcaatatctttctagagtaaattatcaaacaaaataaaaatatccagtatctggatatttaatctatcgattcaatataattggcaatttgctgtccagcaatagctccatcattggtagctgtaacaacctgccgcaatattttttttctaacatctccagctgcataaagacctgttattttagtttgcattgtttcatcagtaataatatagccattatcatcggtaattcctaaatctcttataaattcagtgactggatccaatccaacaaatggaaaaactgctttcactgccaattcgctaagttcccctgttttactatcttctaatactaatttatcaactttatcatctttagcaattaaatgatgtggtttctttaaaaaatgaatttcaattctatcattgttaaaaacatgattttgaataatcttatctgcccgaaaaacatcacgtcgaacaattaaatgaacacgattagcaaactttgttagatagatagcttcttctaaggctgaattaccgcccccaataaccgctacatcatctcctttaaaaaatggtccatcacaaacagcacaataagaaactccatgccctgtcaattcttcttctaatggtattcccatttttctttctttcgttcctgttgcaatcaaaacagctttagattgatatgttttatcatttgtaataacttccttataattttgatgatcaacgattttaagtacttcaccatactcttgttttcccccaaaagatagggcatgttcatacatttcataagctaattcaggtcctgttttctttttttgaccaggccaattttcaatttccgcactaacattcaattttcctccaggagctcctgcatctaacatcaacacttccaagccagctcgtgaagcatataaacaagcacttaatcctgctggaccagctccaataattattaaatcaatcattctaacacactccttctataataaaataattattttaatctaaatttatgatacccttaaatatacgctttacccatatattaattattgagatttttatatagtataacataatttttatgacagatatattattatgctttattataaataaatagactctgaatccagagtctatttatgtttttttctagtaaagagtgctttgattccacgtttaataacttggaaaaagcttaatgaacgaactaatttctccgaagcaatatatttattaaccgctcgtaacaatgctttattatcacgagatgaaaatataaaattgccattattcttcgtaacaactgcaaagcgaggaatccattttcctttaaacataacagaggccatcacgtagttaacttctttccatgggatttggatataatctttaacatttttttcattatagaattcaaatgctttatctcctatcataatcttaccataattagcaagacctaaatatgaagttgctttgattgtaaaatccaccttggtatttaaagattgtaccattgacttcctcctctacagtttatttttatcaaactttttatatattacattactccagcaagacgagcaagaatacctacgataaataaagctatgataataacgattggtgaaactttctttttcaataaccagcagcataataaagttaataataaagctgctaatccaggaataagttgatctaagttttgttgtaaagtagtaactttttcaacatttaaaccagttgcacctaaagaactatattgttctaatgcagatttaattccttcagctccatctttgatagtgctccaatcaatatatgcaccttcagattgagttacagtagaaacaattggtgtaaatgaaatacttacccaacgttgtactaacgcaccgatgatgaacataccaagaatagatgcaccttcagtaattttaccaagtaaaccacctgataaatcttgtgcgattgaagtaccaactttgtatccgaattcttgtgtataccataagaaagcaccacgaataatattccatgcaaagaagaataataaaggaccaactacatttccgcttaatgcaagagaagcacctaaagctcctaaaattggacgaagagtgaaccagaatactggatccccaacccctgcaagaggtcccatcataccaactttaaccccttgaatagcttggtcattgatatcaataccattagcacgttcttcttctaacgctaatgtaacccccataactggagctgatacataaggatgtgtattgtagaattccatgtgtctttttaatgctgcaatacgatcatctttatttggatataatcttttaatagctgggataattgaataacaccaaccaccattttgcatacgttcatagttccaagaaccttgaaggaactgatgacgccaagcaactgacatacgatcttttttagttaatttaattttttctgccattgtttctttcctccttcaagattttaataatcatttaaaatatcacctaatggatcaccagaaccagttccgcctccgttagatccaccgttttcttttaatcctaagtaaacaagtgctaaagcaacaccgattgcacctaaagcgatcaatgttaattcaccaattgctgctaatacgaaacctaaagcaaagaatggccaagtttctttagtagacatcatgttgattaccattgcataacctacagcggcaaccattcctccacctactgtcataccaccagataaccatgctggcatttggtttaatgcattagttacagtttcagctggaactacacataataatgcagcaggaatcgcgatacgaataccttgtaataagattgctaaaatttgccacatatcaattgcacgcatatttcctttttcagcagctgcatccatgaagtgtaccattggaattgcaatagtacggcagatcattgttaagaataatcctgctactgatagtggaatagcaactgcaattgcagtagaaatagctgtttgtacattagtacttccaccttgtaatcctaataccatgataattgctgatgctacagaagctaatgcagcatctggtgcaacagcggcaccaacgttagcccatcctagagctatcatttgaagtgatccacctaacataacaccttcagttaaatgcccacttactaatccaattaaagtacacgcaactattggttgatggaattggaattcatctactaccccttccataccagccaatagggcaactataataattaaaattattgtaataatattcattacaaaccctcctgtttatttcaattttaagcatttgctaattcagcttttgcttttttaagaagtgcatcaatattttcatttgaatctgttggtactttacgtacattaaatgtaataccttttgctttgattttttcaatagtttctacatcttctttacccattgcaatcgctttgttaacaacaacttttccgattgagtgagccattgaaccaatattcaattctttaatgtctactccaccttcaattgcacgtaatgcatcttgtggagtttcgaataataacattgctttagtattaccaaaacgtggatctttagcgaccttgatcattttgtcaacaggcacaacgtgagccttaactcctggtggagctgcttgttcaatcatcttcttacgtaattcatcacgtgctacagaatctgatacaacaataatacgatttggttgtgtcatttttgtccaagttgtagcaacttgtccatgtaataaacgagtatcaacacgtgccaaaacatatttgatttttccatcaccaattacagttccttctggaatagcaccttgagattgtgtattagctgctggtgctgcttttggtttttcaggttctaatgattctggacgagtcttaactccttctctagccacacttgtaatatgtgtagcaatttcatgagcagtttccatagataagcgtgaagcatatgtttcaatcaacattggtaaatttaaacctgttacgattgcccatttgtcttcatgtccatcaatcaaaccattagcttgattaaatggagttccaccccatagatcaaccaagaataatacttcatcttgattatcaaaagtggcaattgctttttccatttttgctctaaggtcatttggtccttcgcttggttgtagcgttacagctttgacattcgcttgttcaccgaaaatcatagatcctgattgcatgattccagtagcaaagtccccatgactagcaagaataattcctaccattatatttttcctccctttcttttaaatacttagtaatgtaaaaaaacaagcacaactatcctaaagagattatcatttttattatttataaaacgccaaaaaaacctcctctaaaaaatagttaatgcctgcctaacagttacacactataaagtattcaatttatgtaataataatatcatttataattacactctgtcaagaattgatttctatcattgataaaaacattaactattcattattaataaacgtttttggcacataaattattcagatcttatcgttattaatttttatttcaaaaaattaataataaaaattatttttaatttaataatataaaatgatcataaaacataaaaagttagcaatatttaagctaacttttttgatcaaatcattttatgatcatctaaatattaataaatacttgataatattctttctaaatgtaacgctagatatccaacttctgtatctggtaattctttttttagtactttagataaggcatcacacatattacaagcttgttcatatgcaaaaggaaatttatctttagtaaattcacttatatccatttgaagtttttcattagaattgactcttaaaatcaaaaacttaatatgattcattaatcgtacatatgagattgattgaacatcaattacaatattcaaatctttttgtaatttaacaattccctcatgaataactcgtgttgcttccattgattcagctacttgattagaggaaattgctgaatgaatatgcaatgttataaaccccacctcatcatcattaattactttagatgtatactttttaattacctctttaccttttaacgccacttcatattcatctggaaatagcagtcttatatcattaataaatggatttgatggcataatattctcttccattctttttattgcaaaataaatatgatctgctaaaggtaataaaatatcgttattaactttctcaaatttttgaactgcaagctttattatttcagaggctacttctagaaaaatcggatcaatatattccattatttcatcagattttttcttggcattaaatcctttttgcataagatacttctttgcatttctgggtatttcaaaatgctcatttactttttttgcaaaaccaatacctttatacattataatagcctcttcacttccattagtagctaaaatagtattattattcaatacctttatgaccttatacatatttctcttccctcgcttaattaataacttatctttaaaatagtaacccctctttttatttcgccatattttttttcaatattataattaccttccatttttgtaattaccaacaagatattttcgctcgttgaatttgactttatatattctatatctgcattccacaataaatctcctttttttactctttgatttaatttaacaagaacttcaaatccaactccgtttaatttaaccgtatctgttccaaaatgtaaaagtaattcacatccattatccaatctcaatccaatagcatgtttggttgggtataccattgttataacaccatcacaaggagatacaatcaaaccatgaaaaggtttgatcattaccccatcacctaaaagtttatgtgaaaaaatttgatcacaagaatcttctattggcaaaacctcaccatctacaacattgcccaattctatatatgactgattatacactatttcttgttgataatcatctaattcaactggtacatttaataaatattcatctaatttgctctttattgatgaagctttaggaccatatattatctgaattcccttaccttgtacaactatagctgcagctcctgattgtttcaacaaaccttcgtttaacttttcactatctacaatcgtagcccgtaatcttgtaatgcaacaatctatctccgcaaaattatctcttcctcctaatcccctaacaataagttgtgactgtttatcaatttcaacattatttataggtttattatcaccaatcttatatttcttaaaaatagataatttattattttcatctctacctggtgtttttaaatcatatttcttaattaaatatttaaaactaaaataatatactaaaaaatatactattccaattggaattattaacatccaatttgttttactgtttccctggagcacaccaaaagtaataaaatcaattaatcctcctgaaaaagttaacccaatcgcaatattaaacatatgtgctatcatataagcacttccagctaacaatacctgaattccaaaaagtaaaggtgctgcaaataaaaatgaaaattcaatcggttccgtgattccagttaaaatacttgtcaaggtagccgataataataaacttcctatcgcttttttagactctggctttgcacagtgatacattgccaatgcagcccccggtaagccaaatatcataaatataaactcgccagtaaaatatttagtcgcttcactactaaaatggatagtattaggatcagctaattgagcaaagaaaatattttgaccaccgtgtactaaaaccccattaactaccattgatccacctacagccgtttgccagaatggcaaataaaaaacatgatgtaatccaaaaggaactaaaagtcgtttaataacaccataaataaaagtaccaaagtatccagatgtagaaacaaattttcctaagacatatatagaattttggataaatggccatagataaaacataagtataccaacaaataaaaaaactattgtcgaaataataggaatgaatcgctcaccttcaaaaaaagacaatacactgggaaattctatgttgtagaatttattatgtaaaaaactaactcccaatccaacaataattccaccaaaaacccccatttctagtgatagcataccacaaactgacgttatcgtcccgttcaaaacagtagaatcaatgatttgatcatcaagaatgatttcattcaatgttaacatcccatttatcgtagtatgcattacaaaaaaagcaataattgccgaaagaactgcaacctccttggctttttttgccattcctaaggcaactgctgcggcaaatattaatggtaaattattaaaaatgccactgcccactttagttaaaattactagaaagtcatttaaaaaagtacctttccctaaaattgcttctaaatgtaatgaagcaattgtcgtctcattggttaatgagcttcctattcctgaaaataatccggcaatcggtaatactgcaattggaagcataaaactacgacctattctttgcaaaatactaaatactctcgttttcatactgtcccccattctagataaacatctttacaaacccattataaatataataatcatcatatcctcttaatgtcaacaaaataaagtcaaatttcttaacttattttttataattaaaaataaaaattgatagaaaatcatagttgatcagccatgacctctatcaattatccatttctattatcttgtcatgcctttattgctgattttccagtttttttacaatatacataacctgtaataccaactaacacaaaagcaattgagactaattgggctgtttttaatcccataaaatacaaactgtctgttcttaatccttcgataaaaaatctaaagaacccataccaaataaaataactaaaaaactgttctccctgtttagtctgaattttacgtatcaaaaaataaatgacaaaaaaaccaattatatttacgatagattcatataaaaaagttggatgataatattgtccgtttatatacataccattaataataaactctggaagatgtaacgattttaaaaaatctaaactcacagcaccaccaaaagcttcctggttaaagaaatttccccagcgtcctaaagcttgagcaattaatacgcctggcatgatcgcatcaccagcaatcaaaaaatcaattttatgtttcttgaaataccaccagctaaatagcaaacccgccagtatacctccttgaattgcaagcccaccatgtctaaacattatgatttcaagaggatcatttgcatacaattcattccacatgaagattacataccaaattcttgctccaattataccaatgatcattaatccataaaaataatcagataaaacttctctatcaaaacccattttcttgaaattatattgacctatcttataagcaataatagcacctgcaataatacaaatcgcataccaggcaattgaaaaagaaccaatttgaacaaatgttttgccatcaggaaaaaatgtcatattttactccttatttttattaatattctttaaaatccgatcaacaaattctttactagaatctacgccgtattcgcgtaagcgcatgttcattacagcagcttcaataattactgacatactacgaccacttgatacgggaacaacgattttaggaatcttcactcctaaaatttcttcagttgaatcattttcttcaacaccaactcgagtatattcacgagatggaacccaacggtctaattggattattaaatcaactgtatctttgtctaaaatcgaactaattccaaacatcttagaaacatcaataactccgataccgcgaatttctaataagttagttaatacttccggtgccttaccaacaatattttggcctaaatgatataattctacagcatcatcagcaactaataaatgtccccttttcactaattccaaagcaatttctgattttccaataccactatcacctttaataataactccttttccataaatatttaaaaatactccatgaattaaagtttcgggagccaaagcttcgtcaagtttattagttaattcaatcgatactcttcctgtcgctgcttcagttacaaatattgggaaatctttttgttttgcaatctctattaagataggtggacattcatttcctttagcaataataatgcaaggaacttcttcattaattaaaaaaggaaaaatttcgcgctgtctttcttcagacatttcattgataaaagctgattctttatcaccaaaaataattatccttcgaaaatcactatgcttaaaaaaaccagctaattcaaatcctggtcgatttatttcagcaacataaatcggtctttccagagccttttcattaccagtaacttgaacataatgctctttatttaatatttcaccaattgtaattgactttggcatttttacatcctccctacaacattctctttaaaaaacttccagtataactttcttcacatttagcaactttttctggtgttccagctactacaactgttccaccaccgtcaccgccttcaggtcctaaatcaacaatataatcagctactttaataacatccaaattatgttcgattataataactgaatctccttgatcaacaattctttgtaatacatcgatcaatcttgaaacatcgttgctatgtaatcctgttgttggttcatcaagaatatatactgttttacctgtcgcttttttttgtaattcactcgctaatttgactctttgagcttccccaccagataaagtagtcgcactttgccctaatttaatatatcctaaaccaacatcttgtaaagtctgtaatttagcttttatcttaggcagattcccaaaaaattctacggcatcttcgattgtcatttctaaaacatcataaatatttttttctttatacgttacttgtaaagtttcctcattatatctttttcctccacattgttcacatggaacataaacatcaggtaaaaaatgcattgagatacgttttagtccatcaccttgacaagcttcacaacgtccacctttgacattgaaactgaaacgtcctttatcatagccacgcattttagcttcatttgtttgcgcaaacaaatcgcgaatgtcatcaaagactcctgtataagtaactggattagaacgtggtgttcttccaattggatcttggctcacttcgataactttatcaatattttctaaacctaaaattgctttatgtttgcctggtttttctttagcgtggtatatttttgcacgcatcgctttgcccatgatttcattaactaaagtactcttaccactaccagaaacacctgttactacagacatacagccaagcggaaacttaacattgatattttttaaattattttcttgggcccctttgatttggataaagttcccattgcctttacggcgtttcttaggaacatctattttcaaccgtcctgataagtactgccccgtaatcgatgccttacagtccatcacttcttcaggtgttccggctacaataacctgtccgccatgaactccagcacctggtccaatatcaacaataaaatcacttgcgcgcattgtatcttcatcatgttcaacaactaaaacactattacctagatcacgaatattttgtaaggtcgcaatcaatttatcattatcacgttgatgtaatccaattgaaggttcatctaatacatataacaccccagttaatcttgaaccaatttgcgttgccagtctgattcgctgtgcttcgccaccagaaagaccaccagcctttcttgacaaagttaaataacctaatcctacatcatttaaaaagcctaaacgatcttttatttcttttaggactaaatgagcaattttttcttcatattcactaagtttaagttcatcaataaattgtaacgctctttttatcgacatatcggtaaattcactaatatttaaaccaccaacgcgaacacttaatacttgatcatttaatcttcttcctttacaagtaggacatgtatgttctgccataaatgaagcataccactcttttgaccaagatgaagtggtttcttcaaatcttctttttattaaagtttttacaccttcaataggttttgttgtctttgatacattaccactactagaaacgatctgatatgatatcggtttatctgaaccatctaaaataatctttaattcttttttagtgaaatcttttaatggtttatctaaatcaatcttatatgttttacacaaaactaaaaatctttgccattcaaccctatcagttcctactgaagttttaaaataacgcaatcccccttgattaatactcaaattccaatcagggatcaacaaatcatcatctacttcatttttgattcctaatcctcgacaatcaggacaagcacctaatggattattaaatgaaaataatcgtggttctaattttgggacactaaaaccacaaattggacatgctagatgttccgaaaacagtgcttcactgccatcacttaaattagaaacaattacttcaccaccagtaagttttaatccaacttctaacgaatcaatcaaacgactacgaaaaccttctttttttacaattcgatcaattactacatcaatattatgcttcttattcttatctaaatcaataccttcatctaatagtttgacttcaccatcaacttgaaccctaatataaccatctttcaataattcctcaaacagatccttaaatgttcccttttgattttttaccaaccgagctaatacttgtaatttactaccatcaggatatttagcaatagtatctgccatttgtttaatagtttgcgattcaattatagtatgatgttcaggacaataagcttttccaattcgtgcatacaacagcctcaaataatcaaatatctccgtaacagtcccaactgtagaacgaggattatttgaagtcgttttttgatcaatagcaatagctggtgataatccttcaatgctatcaacgtctggtttttccatatttcctaaaaattgtctcgcatatgcacttaatgattctacataacgtcgttgcccttctgcataaatagtatcaaatgccaaagaagttttacctgaacctgataatcctgtcataataactaatttgttttttggtatttcgatattaatattttttaaattattttctctggcgcctttaataactaatttatcattttccataatctacctaccttttatcatccttaaaattgctggtttatcatgacctcttaactgaagatcatatgcccaatctaacagttcacgatatttcgatgactctttgattcctaagctttttaaatcatttccattaactaatggtttttttgctgtctttcctaatcgggccattttttccttcatcacacgatcaaaattattaatactttcatgttcatctttgtatctacctagtttatcacattttgttattaaaattaagtcttctattctaataattccgtcaatttcttttaaaatttttaaataactgtaatctttagcaccatttctaacgatattcattaaatgcatatgataataaataattgttttaatataacgctgtagttttttatcaggaataaacgcttttaattgctcgttaaaaacttttactccagcctcattatgttttggggcatgaccttctttcgtggtgacaagaggtttgccaatatcatggagtaaagctccccacataaaacctaaaggattacctgtcttttgacagcacagcgcagctaaatctgttactaataaagtatgacgccatacatctccttcagggtgataatctaaacgctgcattgttcttgacaatacgtctaagcatggaaatagtgcatttatttcttttagaaaagataatccaattgatggatgattacttaaaagtaatttgttgtattcttgaaacactctttcattgcttaaattttctagtaatcctttttttaccatttctttacatatttttttagtttctggctcaatataaaaatcaaacctagatgcaaactgggctatccttaagacccgaaggggatcttcaggaaaggtttttcgatctaccattttcaaagttcttcgttttaaatcatcaagaccatgataaaaatcataaattttacctgttttcacttcatacattaacgcattgatcgtcagatcacgccttgaagaagctactttaaaatctaaatctttgttgacttcaactttgaaatcttgatgatatttacctacttttttttctgttctaggaagtgcaaaatcataatttgtcaaacaatttaattttaaaattccaaatgacttacctacacaatttacttcaccatatttattcaaaatattttctaactgttcaatcgtcaaaccatatatttcaacatcaacatcatgataatcaacttttccataaagcagcatatcacgaactattcctccgacaagaaaagcacgaccatttaagctttcaatatccttaaaaatttcatttacgggataatcaaattgatatttatttttcaccttgaagctccaatatgatatctcttagttccatggctctttcaaagtctaacactttcgcagcatctttcatctgtttttctagttcatgaatcattgcctgcttatctttcttatttgctttacgtcctttttttacaaggcttgcagcatcatcaataacttcttgaccacgtattgcatcacgaatttctttatggatcgttgtaggaataatattgtgttctttattataagcatcttgaattttgcgacgacgattagtttcttcaattgcatatgccatcgattcggtaattttatcaccatacataattacttcaccattactattacgagcggctcgaccaatagtttgaatcaatgaacggttacttcttaaaaaaccttctttatcagcatcaagaatacagaccaaacttacttccggtaagtcaagcccttctctaagtaaattgatccctactaaaacatcatatttacctagtcgcaaatctcttaaaatttctgttctctctaatgttttagtatcactatgcaaataagcaaccttaattcctagttcttttaaataagcactaagatcttcagccattctttttgtcaatgttgtaattaatacacgttcatttttatcttgacgaattttgatttcattgataatgtcatcaatttgatctttagtaggtcgaacttcaatttttggatcaagtaaacctgttggtcgaataatctgctgaacgacctgattatttacatgttctaactcataatcaccaggtgttgcagaaacataaattacttgattaattattttttcaaattcttcaaaccttaacggacgattatctaaagcactgggcaatctaaaaccatactcaacaagagtttctttacgcgagcggtcaccattatacattcctcttacttgaggtaacataacatgactttcatcaacgatcattaaaaaatctttaggaaaataatcaattaaagtatatggtctttgtccagctttacgtccatcgatatgacgagaataattttcaattcctggacacatgcctacctcttttaacatctcaacatcatgccgtgttctttgttctaaacgttctaattctaataacttagtttcagctttaaattcttctaatcgtgtttctaattcagcactaatagtatcacaagctcttaagatttgttcctttttggtaacataaccataagcaggatagatcgtatatgtattataagcagctaaaacatgtccggttaaaggatcaacctctgttattctttccacagtatcgccaaataattctattctaattaaataattttcactatgaccaggaacaatttcaattacatcaccacgaaccctaaaagtacctttagtttgttcaatatcattacgctgatattgacgatcaactaaatatgttaatagttctttacgatcaatatcctgatcaacacgtaaagcaaaaatcatttctttatattgttcaggattaccaagaccgtatattgaggctactgatgctactacaataacatcttctcgttcaattaatgaattcatcgcagcacttctaagcatttcaatttcatagttagttttagcatttttgtcaatgtatagatctcttcctggaatatatgcttcaggctgataaaaatcgaagttggaaataaaatattcaactctattttctggaaaaaattcttttaattcggaatacaattgtccagctaatgttttattgtgagctaaaacgagcgtcggtttattaactgcagcaataacattagaaacagtaaaagtttttcctgttcctgttcctcctaataaaacctgttcctttttcccagcctttacaccagctactaattgttcaattgcttctatctgatctcccatgggtttaaagggagaaactaatttaaattgatgcatttatccacctcctataagtcttttctattatatcaagaaaacaaccaagttaaaagaattatacccatgacaataaaaaacataactcatcatatgattatataatatttttctaactcaaaaagaagagctaataatttgctcctcttatctcaactacattattatcccattatctctaataattttttatactgattatcattacttatatcattgatataaatcaatattttacttattaatacattcttgtcattatcatcatagatgccatctacggttaaattattagcactttcaaactgttttagactttcaactgtatcactagaaaaataaccgtcttctcttttacaatcataacctaatatttttaaccctttttgcatcgttaaaacacgatcatcaacacaatcatagcttaaactctgatcaatagccttggttgaaatatcactaatatcaatattttcaactaaataatctggtgtcaatccttttccattgatccatgttccacttggcagcatccatctagcataagtatatttcaaaacagagccatcacttaattgtttttgtgtttgagctgtaccttttccatatgtttgagttccaatcagcttaaaatcacataattcttgtaatgctccagcaacaacttctgatgccgacgcagtctcaccatctactaaaatataattattagcaaaattatatttatttccatcgcctgctttagttttttgaatagccccatttttctctttcatctgataaattgttttaccctcatcaacaaaaagatcaagtacatcattggcagcaactagataacccccgccgttaccacgtaaatcaataactaaattacttatctgttcatcaacaaaagaacgcaagattttttcaatttcttcacctgttgttgttccaaaagtactgatttcaatataaccaaacttcttgccattttcttctcttatttcaccatttaccgctgtttctacactaccacgttttacatcaacatcaaaagttttaccatctcttatcacagttaattttacattagtaccagcctgccctcttacgagttcttttacctcgtcagcactcattttcgcaatactagtgccatcaacattagtgatagtatcacctaccagaatgttactttgactagctggactgttttgatatactttagtaataataattccattatctaaagcgatataagcaacccctatgccatcaaagtttccttcaacgctttgattaaaagcaacagattcttcaaaagtaaaataagatgaatgtatatcacctaaggaattaactaatgcggcaatcgaatttccttcaatatcaacttctgtatcattgggattataccaatattcatttaaaatttcatatgcttcatctaatactgatgtatctgttccattattattaaaacttatatctgtcttttttactatatagcctgaaacaaacccaattcctaaacagatgatcatcaagacgataaatactgtctctttaaaatgactcttttttactacttttttaggctttggatttggtcgaataaaatcttccatgttaacacctcacattgttatattttagcatataatctaaataatttttagtaaaaaatcaaaaaaacattattctttataattaatcatcatacccattattattacacatattcccgcatatcatctcacctttataacactatataagtttataattaatataggactattaattaataatattttaattttaaaatttattccccaggcaattattatcattatcaaaaagaataaataaaaagattcatttcgaatcttttaattcatatactcattgattcccttaactattccggtgacaattttatcctgataattactatcagataatagctggtcttcctctgggttagacaaaaatcccatttccacaatcgttactggaacttgacaccagtttatcccactcattgtatcgctaatcataaccccacgatttttagcaccagtttcattacatatattatttaaaacactttttgataatgcttgtgaagcattggcaatttgatgacagtattgatttgaagtagatggtgctattgttaaagctcctttagctccgcttgaactgtcactattacaatggatccgaataaaagccccagcattattttcattagcaatttttgctcgttcactatttgacatgtcaacatcctgacttgttctaaccataataacttggtacccgctagcttctaatttatcttttaatttaaatgctacttctagatttattaaagattctaactttccagtgacaacgcctgttgccccgcttgttactttggcttttgtctcactagcacctggtccaattggttcttgttcattattaccataacgctgatgtccagcatcaattacaattaaacgactatttcctacgattggtaaattttcttgtggtaatgattcatttactggttcttctttagcaataacaatttctcttgaatcttttataaagctatttctttgttcctttacaatattagtatcgcttatcactgtatctatttgtttttcctgattacatcctactataaaaaataaaattaggaaaacactgagtaactttttcattttaccacctgctttcctaattattataacattaactattaataattgcttctaattcagtatcaatcatttcttttaatgtttcgcagcttttatcaaatttttcctggtcaacattatttaaagataatggtataactttagatattccttgtctattaataattgctggaacaccaatatatagaccctcttgattatattccccctgctgatatgctgaaacagttaatatcgcattttcatctccaaatattgcactgatcaaacgatttaacgataaccctattccataataagtcgcattttttcttttaatgatttcatatgccgcttgttgcacctctttgtatatattatgaagctggttcatatcaatattcatttcaacgatatattccatcatgcttttacatccaatataagtattcatccatggaacaaatgatgaatcaccatgttctcctaaaatataagcgtgaatatttgttgaagaaatatttaaaaactcactcaataagtatctaagtctagcggtatctaaaatcgttccacttccaattaccctattagctggtaaataggatactctttgtacaacataactcattaagtccacaggattactagcaacaataattattccatcaaatcctgtagccatgattgattgagtaattgatttcatgattttagcattaatacttgccagttctaatcttgtctgtcccggcttttgagcagcgcctgctgttataacaacaatatcagcatccttacaatcatcatagtctcctgcttttacttttaaactgcttttactataaggtagtccatgacttatatccatggcttctccaattgctttttcttgatcaatatctattaaaactaattcatcaatacctcccgtatttaacactgaatatgccattgacatcccaacaagacctgttcctatcaatacaactttttttaaatcttcatcttttttcattgttagatcctccttataatctaataataatatttattactaaaatattcatttaatatgcacttttatttattgtttcctaaaataacataataatactaaaaaagtagtcactttttgactactaaatcatgatgattgatattacatatccaattactattgccacaacatatgagataagcaatattttaagtgaattctttctgtcttcattatatctcaatagtgccaaagttcctaccccagcacttgtagttagtccagtaagtaaagcaccaaaacccagtccaccacttacatataattgtgttaaaataaccgatcctgcacaattagggataaaaccaattattcctgcaataattggttgaaaaaaccaatttgtttgtaataaattacttaaattttcttcaccaattccacttataataacagttaaaataacattagtcagtaagataaaaataaatatattaaatgtatgccttatcgcaggtatgaatatcccattttgacaaccacaatcacatggctcgatttgtagatattcataattatcacgatttttatgatttatgtgatcaactattagtcctactactgtcccaagaattatttttataacaattaataaaactagtatttgccacaaatcaggatgaatagctaaaatagcaagagcttcatcactagttgctataaaaatagctaatagtgtccccatagtaagatagcgcatagaatatagtttagcggctataacagaaaatccacattgaggaatacttcctaatatcgatccaataaaaggaccaactttaccaaattccatcactttattaataacatctcggttggaaagatattcaactaataaacatgctaaaaataaaaccggtaatgccaccaatgattcttcaattggctcaattaatatttccatttatacactccaatcttttaagttagcttattataactcatatataataccacaatatttaatattttcaatctttttactattatacaacaaacaataaaaaaataataattcgtctaaacttaacataaaatattataaaaccaataaattgctataaataatttacatatatacaaaaataattaactcgctataaaaaaataaatttttatgcctaaatctgactaaattagctcttttattttaatttatgttacaataacactagttgtgagagcgtttacataacaatgggatgaacataactttatttgaaaggatgtagatattatataattataatgttatattttaatatgtttttttactttaaaaattagtacttctttttattttatagttatgtaatgctcatatgactaaaactataacaaaaaggagaaaattttatgaaaaaaattgttgcatgcatactttcaataatgctatttttgggttcttatactagtgtaagtgctgcccaatcaccacaattagaaaaggctacaatacaatcaagtactacagcttctactaaagtagatcaaacacaatttacaacccttcatcctgatgatgttttaataagtggaatatctgcatctataatcaagcacagtatatcggctcaccgtgaagatgatggtagtgttactcttactattaatgaaataatacacactgtaagaggatattacgaacacctagctactgatacaagtggagaaaactttattccaagtaaaaatactgcatattatacaccttctgaaggagtttatactatctctcttagtgctgatagtgtttcttctgatggttatgtatacttaaaaactgctattactccagtaggtggagatgccgtattatatcaatataattataaaattcctgttgattacaataactttagtactgcaaatagtagaggttaccttactttaaacgaaaacggactatatacaccatgtattagtgctcaacttgccttttttactgctaatgcaaaaaaactttcagataattctgttgaagtaatatttactatagataccttaaatacaagattaagttttacacataaagcaactagcaaggatggtgatatctttatccctcaaaaagataaatggtatccaataacttctactgcttcaccaggtcaatcatttaaaattgtattaccagaaaatagtgtctcttctgagggctttgtttatttagaaacagtttttgatttaccaattggaatgattaatgctggttcaataaaactagcaattgaaaattaataattaaaagataaagagatgaaatttaaatttagatttttaatacataatttcatcttttttattattcaactataaatattaaattgtataatatttgcaatatttacttttacattacttattgaatactataagtttagttttaaatatttattcattaaaacataactaataataacgcaatattatacaaataatcaggataaaaaagatgatttttttaagagctaacttaattcaatcatcacattttatttgctatttatctaatttacttaaaactaaacctattcctaaaaatagtattgcaaaaccaagaaatccaccagaagtagaaagtaatgtttttaaaactgttacccattcatctaacatagatactccatactctgctgcagattcagttagtccaataaatccatcaacagttaaaaatatagttataattagaaataaagctgaaaaaacataaaataatatcgctgattttttcttcaatttaaacaccccttaaaaaatattttaatatatccaaacgtatatatcaataaaaagaaaagaggaattattccatataggtcaaattcctcttttttaattagataaaacctacaatttttaaaatatataatactttaaatattaattagatttttttcttttctttgctccataaattacagcagaagctaaagctaatccggcaattgatgtcatcatactagttgtatctccagtattgatacttgctgttgtatcacctgaagccacaggagatgtagcttcattagctgaattatttactactaagttattaattcccgcttctaatccttcaattgctgcttgtactgttgcatcatcaacatcattatttcctaatactgcttgtgctgtctttaatgcatttacaaatactccccaagattcttgagtgtagtttgctgcatttaatgtttgagctttattaattaattcttgtaatagatccttatttggaattaatcttaagtctaagtatgctttgatcaatgcttcatgtgctgcatctacttcagcttgtgttgcatttggattatctaatacagctttagcagttgccattggttctgttaatccagctacactagcttctgtatatagactcttatctaagccatctaccatatcatatgcttcttgtaatcttgatttatcagctcttaagactaagtttccaattgcatctgttaaatcgttaaatgctttgttaacatcactttctaaagcattttcatcattcattacatcttttgctgcatctaatgcttcttggaatgctgtccatgaatcagttgtataatttccttcttcatatttttcagcttcattgatcaaggcttctaaagcactcttatcacctttaatgaaatctaacatgtgaattgcattagctagacgatagaatgcgctatcaattgtagcttgatttgcactagtatcagctaaaactgcttctgcattagcaagtgcagtttcaaattcagctactacagctggtacaacattatctaatgcaccttgttctttaagtgtattagctgtatctacagcaatttgtaatgctgccttattagctacaacttcttcaccttttgcaagaccatagaagtttaattctgcaatagaagcataagcgttaagtctatcacctaatgattcgatagcgatgaatcttacatatctagcttctactgtatcgaacttaatttcttttgcaacacctggttcttctattgagctaccatcgtttgcaatatatccttcaactactggtgtaaagatcttattttcaccttcatcagtacttacttcaatacgataatgtgtaatatgaccatttctactattttgacgtgccaacatatctacttgttctaagtcatatactgcacctaaatcgatggttacatattgaggtaatgtataaccactattataatttgaatgccaaattgtatctttattaccatcaattacataacttgcatcttctttttcaactgctgacatacttgattcatcataacgactcattcctgattgaggaattaagtttaagcttgatggttgatctgtgttagatcctttaaattcaagtttgttcatagcattaacaatattgattgttgcactatcaatgtcagattgtgatgcttcatcagaagcaattaattctttagctgcatcaacagctgctttaacttgttcatagctttcagttgtatataagtttttatataagctatcaaattttgtaatttgttcatctaatactgatgtatcaacaccaattacaacttctacttctgttgttgctacaaattgaccatcttcagaagtagctgttaaagtaacagttccttcagaaataccttgtactgcataaatatatgtattttccattggaatcttaattacttttgcaacactttcatcactacttgtaatatcgtagaatggattacttacattatttggagacactgtagcagatacttctgctaaagcacctacataaactttactagcacttgattcatcaaattcaatacctgttgcatcaactgcgctatcagttacaaattcaatctcacgtaatgataacatacgatttgattcgcttccagtgctagttcctgtagctgttccagcacttgtcataggtgtaattacaacacgatcaatattagtagcttcagcaggtactgtaaatacaaattcatcctgtgcagaattgaatgtacctaaatcatattcagtatcgccactataagctacagctttaatacttgttacacgaccgttactgcttgtacggttgtatactgttactgtttttaatggttcagctttgttgaattcaaaattcatatctgtaggaagttttacttcttcagcgatatcagtttcagctcctaaataccatttgaattcagcaagtgttccacctttatcaccatctaataataaatcacgccaatttgattgttgccataattcatcaccagtcatgttttctttaacatcattactgaatgtaatacttgcaaaatcagaagatcctaaaatattcttagtttctggtgctgttggaacttgtgtaatatcaattaaagcatctgccttagataaatcttgtccaactacaactgctctagttgctttagtatcccaagtaaaatcagcattagctttaattgttacttttgcgatacttcctgttccattaattaaatcttgctttccaacatttgtaaagcatacatagttatctacagatccatctgaatggaatctagtttttgagaagtttctcatgaatactgtttgtaatgaagctgaaccaaaattagttacttcaaataaatcagtatcaactggcatttcaacactaaatgcatttacattctttaatccaattccatagtaatttaatgttactatatcgccagctttaatatctgtttttgaaggaatgatttcaatcttaccttctacaccgctagcagcattagtaatttcatcacctaacatactagctacataagcaatatcataagcatcgataatatcattattatcaatgtttcctaatgttgaataatcccaatcactatcaactggtttcaatccaacatagttttcatagaatactaaatcattatcatcaacagcacctgagttatttacatctccaacaacccaagcatcagtaccatctactttgtatggtgtaatttctgaagctgagaagaatccacctatagaagataatacgctcaattttaagtaacgagcttttaatccatttaaaggcatttctttaatatcatcaacttccatattacttctatcatatgtccatgcttcgttagcatttccatcccatactttagtatagttgacaccatctaaacttgcataaacatccatacgataaacagtaccattacctttattatccatacgaggttggtaagttaatttatcaagttgataagctgctcctaaatctaatgttaacatttgatctggagttacagcattagttgaatggaacattgtattagtatcatggtcaaatccatttgctaaagccccccaactagctccatagctccagcttggagtaacagttggaacattgcgatatggatcatcatcagtttgaattgtaattaaatctgaccaattagaataatgtccattagcagctacagtacgtacacgataagtatggtttgttaaatatgataaatcaacttgtgtgtaagttgtatctgtaatatttcttaatactgtaccatctacttcgatatcatagctaacagcttcatctgttgcattccatgcaactgtaatttcagaatcagtttttgatacttctgctaatcctgttggaacagctaaagtttcatctaaaacatcttcacctaaatcttgttcatttttaaatccattaacatttactgtaaaatcataagcagtaacatctactttttcagcagattttacatataatttaggagttgttgtatcttcgatatctgcataagtagttccttctgtagcataatctttaacgattactgaaggatttggattgtagaagtatacattatctgttgcagcatcatattcttcttgagttgtaacttgtctaaatgttacatcttcaccagcaacattaccagttacacttgtaggcgcttcagatacatttacaacaaattcagtagatctttcttttaccattccagaatagcttcctactgatttattagcttttaaagttgcagttccgttttctacatcagaagttaataatgtagtaacagatgctccacctaaagtttttccatcatcttcatatgcttcaaattcagatgaaccatatggatagaattctacaatacgttgagatctatctagaccacttgtatttgtttctgaaatagcttcagggttattgttttctggatacattggaataatagatccatttcttacaaatacaggaagtttccataatggtgcatcaaagttatttaatacttgtccacctctgtattgttgtcctgtaaagtaatcaatccaaatatcacttgttgaaggtaaataaatatcattcctaatatcatttccttgtgaatcagcatttgtgttttgataaataggtgctacgataaaattatctccccacatgtactgatattgtgtgctagttcctaaagtatatggattagcttcttctaagaacattgctcttatcattggtaatccaccttcagcagtagcttcatgtgaaattgtattaatatatggcattaattgtgcctttaattttagatatgttctattgatagatgttgcatcttcaccaagtgcccatggtgatttttggttagaaccccaaccatccatatctaacatataagtagtaaatgctttccattggaaatcacgtgtttgaacagttgaatttgttccaccgaagatcccatccatgtcactacctatatttggttgtcctgataaagcagttccgatatatgttggaatatggaatctaatgtattcccattgtccacctgtttggtcaccactccagataccaccataacgttgagtaccagcccaaccatttaaagtaacaatgtttggttttaaacctgatcttgaagcaattgcatcataagcaacactgataccatttaaagccattgagtatccagctccaacccaagcaacgtcagtttttactgagtgaactccagcttcaacttctttataaatatcacgttcccctttttgaggattagatgaatctgcaggccataagtttgattgagtccataaacctgtttgaacccctttagaaattgcataatcagcgaaatttcctagattttcaatgtctcctgcttgactatctgtttgaccataaccacaaccatatccatcgtttggcaagaaccatccaagtggcatatcattgtcttcatgatcttcaataatttgttgagcagttgtatttgcatcacctaataatgtttccttttctcctccattatcagattgtgattctttataccatttgtctcctaatttaactgctccgcttgttccttctgatacttctaaccagtaatcacgattgtagcagtttaaatgtcctaagtatgaagcatattctggtaattcagcaggatttcctgttaattcatagtaatcacctaaaatatcaacaggttcatcatcaacgaaataatatgcatcaaatcgtttttcattatgagtagtagttactacattaccattagtagatccaaaatcatattcaccaggtttccaagtgtttcttacaacaccatatccatctgtagaccaatagaatggattagggctagttactgatttgtcaacccaagtattagtagtagcaattttaatagattttcccttgtgtgagaaacgaccattttgtgttccaccaccatagaaatactcatcatcatctgtttttaaagtttgaatcgtacttcctgttttatattttaatggtgcagcttcttcccataccactgttccgtctgctttcattaattttactaatgtttgagctttattaatttcaattttaattttttcagttgaaattgtaacagtagtatctgtctcctctaaagtaggaacaacattatactcactttcatattgctcatctgtcttgtttgtaattgttgctgtgtggtcactactatttgcaactggatattctctaaatggttccccttcaggtgccatatacattctaaacacattttgttctaagaatgtaaaacgaattttttcaccagtttggattgttaaatctactttattaccatctaatacagcagaagtaacagcacctaaaacattgtaaccagcatcatctgtagcatatgtagatatctcattagatacagcattatttgctgctaaagccatcatcgatgtactaactgttgaaagagacatcaccgctgctagtgacaatgcacttattttgtgaaatgtttttttcttcatcttgcttcccctttctctaaaataataaacatttaaatccgttaaaatattcctctcatccctcctctttaaaataaatttaatagtaattaaaaatattttttaactaccttttaataaacaataccctaatttactatcaaaaatagtaaattttaggcgatgatagatataaacctttatttttataagattttcaatcatccttttttattatatataattgaatttcaactgtatttagagtgattaaaaaatattttgcacttttaaacaattgtttctaagccctttcataatatttaaacacaattatttgattttataccatttctaccatatttaactataaattaagacaattttgtaagctattctacctttcttattacatttcaaaatttattatgttattttccagcaatcattcaatataaaaagtatcttatttttaatgatcgtagtaataaataacctgcacataccatattaataacaaataattaatattttttctaaatgtgagattttatataattaaaatacagctgtatttagaataattaaaaaatgttttgttcttttaattaattataacagcttattaaaaaagacaatttttgattaattgtcttttttgttatccatttacttttatactgtcaacatacttttattaggtttaagtcttaatcctaaatatgcattaactaacgctatataagcatcgtctgttttatcttgaagagcattttcatctgcaattatttcttttgcattattaagtgctgtttcaaattgttcccatgactgtacactatatttactttgatctagatcatttactttatttacaaagcctataattgtatctttaatagcttttaatcttaagttcaaataccctctaactagttcttcatatgcattatcagtttcttcttgactggcatctaaattatctagtacagctttagcgttttccataggttctgttaatccagctaaacttgcaggcgtatatagacttctatctaatccgtctatcatatcataaacttcttgtaatcttgttttatctgctcttaagactaaattttgaattgcttcttgtaaattattgattgcttcttctacttcagcttctgtggcattttcatttgccactacttctttagctgctgttaatgtctcttgtaatactgcccatgaatcggttgtatagattccttcttgatatatttcagcttcactgatcaaggcttctaaagctgttttatcgactattttttgcatttgcgaaatagcagtatttacttttttaacagcttcattgattaaatcaagatcttgacattgattatcaattaatgcttgagcttcattagttacatttcttaaagcagtaatactttcttccaagtatccacttaaatcactatttagtaattcatttgcacttgctataacagtttttaattcatttgtcgctgtagctaaatatagaacatcactttcttcaattaacttacttaaaatttgattaacagcatcattagaaatgttatcaacttcattttgaagtaaagcttcagcttcatcaattacttcttttaattgtgaaaattcttctggtgtataatttacttccaaatttttacattcttcaagctttatttgtaaagtttctaataattctgctgatactctttctactaaattatctattgcttgttttaataattcaactgctgcatcaatattttcttgactagcatcttcgtcattaattactgcctcaccatttgaaactgcattaactaaaacggcataactatctttagtataaatatcttctttatttttagcttcatcaattaaagccttcaattcttcggtattcaattcaaatacagttactaaacatgtatcttctttcccgtttactgtggttacagtaataactgtttcaccagctcttttagcactaatcgtaccattttcaacagtagccactgtttcatcgctcgaagtccaatcaagtctagtatcctcagttgtattttgaggattgattgttgctactaatgtttcactctttcctgcttttagaattaattcatttttatttaattcaacagattcaattgggactggttttttagttactgtaacttcacaaatagctgttttatcattagtagtagttactgtaataatggccgttcccggttgtttagctacaactgtaccattttgatcgactattgctactgcttcatcacttgatatccaattaagtgttttatcatcagtagtattacttggattaattgttgccactaatttttcgcttgcttcttcttctagaactaattctgtcttatttaaagtaatattttcaattggaatacttactatggctggattaacagtcaccttacattcagctctttttccatttactgtttcaacagtaattgttgctgttcctttttttacagctgtaacatcaccattttgatcgactgttgcaacactaggattacttgatttccatgttaattcttttgaatcagttgtatcacttggattaattgttgctcttaacaattgcgatgttccttcttcaagagaaacagctgtaagatttaaagctacttttgtaatttcactaattacagttacattacatgtatcactaattccattacttgttgttactgtaatagttactgttcctggttttctagctgtcaatactcctgttgaactaactgtcactacttcattatcacttgatgtccatgtcaattttttatcttcagttgtattactaggattaatagttgcttttaaagaacttgatgtttcttttttcattactaattcattttgatttaattttactcctacaataggaatatgttcatcacttatagtaacattactagtagcacttaagccgttagctgtttttacagtaatagtagcttcaccttcagatactccagtaacaacaccattattatctattgctgcaatattaggattacttgaaatccatgttaattgtgtattatcagcaattgtatatggtgacaaaatagctacatatttagatgaatcattaacatttaatgttagttctactttatccaaatttattcctgttgtaattaatgtaaaagcatatgcatttcttctcatatatagatgtgcttctgaatcagctattactgaagctactactttaggggaatttgaaaaaatacgactacctatttgacctgattgaattgtatctgggaaagtaacacttcttaaattcatacaatcagcaaacacagtatcgccaatagtttttactccattaggaagtactactgtctcaagtttatcacaatatctaaataaacttgtaggaatactagttaaattttttgaaagttttacttcttcaagactgctacaatagctaaatgtagaagttcctatttctcttactgaatctggaataacaatactctttaaatttacacagccactaaatacattatcagctaatgatgtaatattttcaggaatttctattgtttctaaagatgcacaaccactaaatgttgcatttcctattgaaacaaccagttctggaatattaatatcttttaatgacgtacagccactaaaagctgcatatcctatccctgttacactatttggtattgcaatactttctaggctaatacaatcctgaaaagcactttgaccaatactcgttaatgtgtctggcaacataacttcttctaaccctaaacatcctttaaaagctccagatcctagaacttttacaccattaggaagattaatacttttaagtcctgtacaatcagaaaaagcatttccaccaatagatgttatcgtattaggaagaataatattttctaaagatttacaatttccaaacaccattccactaattgtctgaactccatctggaatctcaacacttttcaaactagtacaatcaaaaaatgcaccgtaagatatcgctttaatttcactaggaatctttaaactttcaagactgctgcaacccgcaaaagaattttgtcctaacgaaactacggaatctggaatcgtcattgtttgcaattgactacattgtgaaaaagcatagttatcaatcgttgtaactgtttctgggattactagtgattcaatacttttacattctgcaaaggcaccataaccaattttcttaactgtttttttgtcaattttttctggaattactagatttttttcactaccactataatttaaaatagtgattgtatcttcatctattaattcataagaataatcaccgcttattatagcataaacagaattattttctgcaacattaaaaataatagctggtaaagaaattgctaatactaaaagtatctttaatagtttcctcatagatcctcctccttttaataatctattgttcttatctgaatttacaattacaatcccctagttacttgtaatagtaatcagaaagtactaatagtcatttataatgtatacttttgtaattttaatgtaaacgttttcggtaattttgataaatagttgactaaaaataacaaaaaatataagagaataaattattagaataataatcataataatttattctcttatttatattcatatctatatttaagtctattttaaatctttttcttcaaaagaatatccctgattttcgtaataatttttcatttttgttaatgaatatttaccatcttctataaaatttttctgatcttcatcagcttctaaagccttatttacatcaacgacgttataatcccattcttcttcaaaatcaaaacttgtatctgtaacatctgcagatacctctaccccttctaattgttcaattatagtttgtcggttaataaaagttgctagaatattattattagtttctgtcttttcgagattatcatatttatgtttaaatacgcccttcactggtgtttcatcttcactgttatattcgatttctattgttgaagtaagtgtctggtcatccattgtactatttaaagttccgacgagttttttatcagcttttatcttacctggaccacaagcaacaagcaaaaagcagatgcataccattatccaaatcttttttctcactatctttacttatatcattaattaatgatatttctcctttcttattgtttcttttaataatataacatatctaaaatgtataaaacaatcactgttatttatgcaaatacatattgatttaactctaacgataaaataaatattataaaaagatatagaacttgtttactattgaacgtaaaactgtacttaaaatacactataatcaaattaatttataaataattatttctcatcaataaataaaacttaaaagtgaaaccaataccttctaacttattctgcgttttcatctcgtttactttttctcttttttaaagtaactggttcattaataatttttgataaatcacctaaaacaaatgcaattccacaaaaaataaatgcaaaagctaaaaaaccacctgctgctgcaataatattttgtaacactgtagaccattcatctaccaaagaaatctcatattgtgctgcagacgctgctaatgttaaatacgttccaactcccatataaatagcaattaccaaaaaaataaccgctaacacataaaacaatatacttttctttttcaaaataattctcctttctgttatgaagtgacctttgtcaagtgaaaattacacattcataataaaattatttaattttatcatcaatggcatacaaaagccccaaaatactagatttatcgacagttaaccactctgttatacggagattggctactccaaggttaatggttcgtcaaataagttctaactatctatatacgtgaatcatctataatttatgatattccagatcgcgacttcttttatatcttatttatgccacaaagaaaggaccgtagataactaaacctgcttctccttttttgaggcttttctatgccattgatttcgtgttctttttttctcgatttttgtcctccatttcttattttttctttaaattttcataattgtatagaaaacatctttttacatcttctatattcttcctgtttccattccccatataaatcctgctagttcccttgccactgccatgatagctacattatatggtttccctcttaataccatccttctaaatcttttttgtaatctttctactgccttatctgcatatgctacgatttcatcctcctgtcctttttgtctttttttcaacgcttttgatttctttccaactgttcctcttactaatgcctgtgtacattctaccagtgtctttctaaccatcgcattccccatcttggtgattggtgtattgctgtatttctccgcgctcgaattctctcctggaagcattcccagattcgccataaatgcctttgctgttggaaatcgctgaaaatcactcactgtgacatgtatcttcattgctgataatgtatctattcctttgaaacaggaaattttagaaaccggttccttatattcctcttcttttgaaaactcttctatcctttcatcatatttttcaatacgttcatttaaataatcatagacttttaaatattcatttaatgtttctcttacgattactggcaattctatcgtttcaagccatttgatatgggccactgtccagttgcttttcccctcatatcttaatcctcgtctcaataccaatgcactgatctgctgtttgattctctttcttgactggatgacatcttctcttagacctatatattccttgatttcattgtcatgttctgttggtacatgaacagctttgtatgaatcgtgcataagattagtggcaatattaaaggcatccatcttatcattttttacttttttatttttgactgatccatgcattgttgatggtgctaatataacacatggaatatcatggtatgcaagttcatgatataaggaaaatcctaaacatccagcttcatatcctgttaaaatatccacctcattttcttcactcattctttctttagctgacttaataaatttaagaatattctttacttcagcagcacattttgtctgtgcaataacttctcctgttgatgaattgattccacataaactgtacgtatttttatggacatccatcccaatataaattatacttttcatagtgacctcctattgtcgttatggtatcgactttcataattttgtttttttactaatcttattatgaatcgtaatccactttttgacaacttaggaggtcacttcatattatctataaaaaaacatttatgcacaattaacactgtacccaaaaaaaggggatttgtaaattcctttaatagtatattctttgcaatttttagttttattctctttttttgtcaatctgattttctcttacccactgatcaatgatttcttcttcaattcctaaagtgtacgtatttaaataacttttattaattcctttttttacataaaaaacacctggtgttgtataaaactcttcaaaatatttatgaatcaccgttaaattttcttcttcagtagcattttctaaatctaaaataacttgatatatgactacatgatgatcctttaaatagtcatctaaaataacatgtagctgtttacaatacatacagtacgttgtcgcaaaacatactacaaatgtctcgttattagccattttttcttccatctgtgccattgtaatatttatgacttcacctggatttgtatcccgtgaataatctttgatctttggtttttctatttcctctttttctacctcagtttctggctcaataatagttcgattagccaaatctttctctgattttttttgacagccaatcatcataaaacaaattaacatgactgctattcctttataaaatctcattcttatccctcatttatactaaaagaggagtgaatttgcttcactcctctttaaagattatttgttagttttcttctttttttctacttaaagctaagtaagctaataccgctatagatgcacctaaagttgttacgcctgcgaagctagttgtatcacctgttttaattgcactttctttagctgaagtatcgcctgtttttacagtagttcctgaatcacttggaagtgcaggattagttggaagttctggtactgtagaattttcagaatcaataactgtcaatccttcaaacgcactgtttaatgcagcgtatgcagcatttacagctttttgatcagcatcttcattatctaatactgctcttgcttcagctaatttactatctaatacagcaaatgtatcagcagtatacttagcagcatttaacccttctactttcttgattagatcagttaataaatctttatttggttttaatcttaattctaagaatgctcttactaatgcgtcgtatgtttcattgatttcatcttgcattgcattttcatttgctaatacatctttactagtttgtaaaacagttgcaaatgattcccaagttgaagctatatatgcctcagatgttaaattatcaactttagtaacaaatgcctctaataatgctttatcacctttaatgaagcttagcatatgcatagcatttgctaaacgatcgaatgaagcgttaatctgtacttcagttgcataagcatcagctaaaatattttgagcttctgtcaatgctgcattaaattcattaacaactgctggtacaacatcagctagatcttcttctgtaatttgacttgctacatcaacagcaattgctaataatgtcttatctggagtaataattggttctccatccttagttactgtaatttcataagttgcagtgatattttcatcagcagctgaaattaaagtgattgtagctttaccagctttaacaccataagctttataaactggatatccattttcgtctgctaaagtaacgattttaacaacatcagtatcagaacttgttactttgaagaatttatttggtgcattatttggtgttactacagcattaatgtcactaagttcacctacttttaattcagtaacattagtatcagctgaagcaattccttcaacattaacttcttcgacatattttaattgtacttcacttaaagtaagcatatggttatcttcacttcctgtagctgttaatgcagttacatcaacaccagttacagttttgtcagtatcccatgcaaatacaaattcaaatcctttattttcaagtgtgatttcttcagattttgttccatcttcaaaaatcaattgagcttttgcactagttaaatatccatttccttgagtttgtgaattaaatacagaaacttcatttaatttagaaggtgtcttcaaatcaaaatgtaaagtcattggtaatttaacgtgttctgggaatttaccatcaacatagttagattctatatcccataataattcaaattcacgaccatatgatccgttaaataacgtagcataagaatcgtatgaaccgctttgaataaatttcttaacgtttgttccatcgtcttctggataataattatttgtcatagtaatatcaaaatcattaaatccatagtaaatcttagtgatggctggaatttctggaatttctggagcatttgaaacatctgattcaacataactataattaggtccaattaaagttactttacttaaatcaactgcatttgcaaccacaatatcttcttttgcagtcatcgtaatcgttgcaacaattccgcttccattataaacgtccttatctcctctattagcaaatgccatatttacatatgcagttccatcatcatatactttatttactgttaaatcttccattgtgcaaatagaagcatcttgtttaatagatacatattcaactttgctaggatcatagttaacaacttgaccaattgcgtttaaattcttaacattatcagcatatacatcaattgtaaatgtctcaccagcttttactgtttcaacacttggaagtaacaatgcattaccagacactgatcctttcttagttgttccaccatctagtttaaacattgtaaatgcataatcatatacatcatagatatcattcatattgatatccataccataattcttaacttgatttgtaaatgttggatcatctttaatagataaacctttataattatttaaatttgtataatcactgtcagttacatctgttcttccttgaattgagatacttcctacagcaaatggactagttccgtctttcttgtataaatgtaatccattagcagagaaataatctctagtagtttcaacaattgttaatttaacatagcgtccaactacattatcaccaaaatttactaccttagttgtcttgtcatatgcccatggattttcatttccatcaaataccttttgccaatgtaccccatctaagctgacagaaatatccatttttgtaacaagccctgcataaattgtatctcctataaagaatggtacgaattcaaacttatctaatgcataagcattaccataatcaaatacaatactgttatttccattcgtcatcggtgattggaaaccagtagtctcatcatcatgatcaaatgcgtttgacatgcttccatatgaaacactgtttggccattgaatatttgttgcatcaagagtatttctccatggatcaagtaatgtcttaactttcaattcatcactccatgcagaatatccttcagcatttacagcccgtactttataagtatgttcagaatcataagttaattcagtatgtttgaaactattgatttttccaactgaatttaagttaccatcaattaataattcgtagcctgtagcatcttctacggcatcccaagttacattaatacttgttggagttatttcttcttctggagctgctaaattagctggagttgctaaattttcatttaatttatcagcagcaatatttccttcgttagcaaatccattaactactaaagtttgagcattatcatcaacatttgtcttagggaatgatacatataattttggtgtcgtagttatttctgtatctttgaatgcttctccatcctttgaatatttatttaagtttggtgcttcatcatagaagtacactgcttcattatttgctgcagctgcttcgaattcttcatatgaacctacttttgttaattctacgtttgtatttccatttttagcaattaatcctgttggttcttttgatacatttacaacaaatgttgtatgtctatttgcatcatatccttcatatgttccttttgatgctcctattgttaatgttgctgtatctccttcaactttagatgtgatatgtgttgttacttctcctccataatcacgttcatttgttgcttcatcataatttaatgtgattccatcatcttctactaaatcatatgatgtttctccatatggatagaattctacgattcttcttgttttatccaatcctttttcatttgtttctgtaattgccattggattgttattttcttcatacattggtataatagatccattttttacaaacaatggtaatttccatattggggcatcaaaattattaataatttgtccaccacgatactgttcaccagtaaagtaatcgatccatgtatcagatgttcctggtaaataaatattatttctaacatcatttccaacttcatctgcatttgtatcttgatatactggagcaactaagaaattatcaccaaacatatattgatattgtgttgctgtactgtaagtataatcatttgcctcttctaagaacattgctctgatcattggaagtccatccactgcttcatgagctgctgtgtagatataaggcattaattgtgcttttaattttaagtacatacgattgattgaaatatatggatctgttgtaatatacggcttcttagcttttgatccccaaccatccatatctaacatcgtttgcgtaaatgttttaaattgtaaatcacgagttgtaattaaatcagatccaccaaaaataccatcaacatcactaccaatatttgggttaccagctaatgattgcccaatatatgtaggaatatggaaacggatatattcccagttaccaccagtttggtctcctgtccaaacacttgcatatctttggaatcctgcccatccgtctaatgatactactgttggacgttttccactgcttgccaagatattatatccatctttaactgaatttaatgccattgaataaccatatcctacccaggcaacgtcagtttttaatgctgatactccagcaacattaacttctttattaaagtcacgtaaattttggaaaccgttataacgtgaatcctgttctgaagcatcaggtgttaaagctgcttgtgtccataatcctgaacgaactccattagcttcagcatattcagtgaatgatgccaagttagcaacgttagcatctacgacactatctctacgagttgtatcttcaccactggtacgtgtttggtaataaccattttgaccataaccacaaccataaccatcatttggtaagaaccatccaagaggcatgtcattatcaacgtgtccatcgataacagcacgtgctgagaatttataagtatcttcatttacagttcctttaaaattatcagcatcaacactaggcccttcgttatttaatgtttcagcataggtattttctggaattacatatcctgaagcttgtcctagttctctataagttttaccgtcttctaaaacccaatttccacttgtactttcttcccatccatcacggttatagcagtttaaatgcgctaaatagaaagcatattctggcaataacattggattacctgtaactgtatagtattcgtttaataatgtttcggctttaccgttgacatcttcatcgtttgatacgaaataatacgcatcaaattcactctcattatgagtagttgcaacaacttctgcacttgtttcaccaaaatcgtatttaccgtctttgaatgtatttcttaacactccataaccttcagttgaccaatagaatgggttaggtgaagagacaccaccatcagtccatgaactttcgtttgcaatattaattgattttcctttatgagtaaaacggccattttgtgttccaccaccaaagaaatattcatcagctttagtatctaaactctgaacagttttattactaattactagaggctctgcctcactcataattgtttctccgcttttgtttttgatagacatttttgcagttgccttatctaaaacaatcgttgcttcatccgtactaatttcccatactgtacctttatcagatacattagcatctggatgtgaatacttatctgagctatcagattgtgcctggatttttgctgtatgtgtgttatatcctggaatatcttttctaacttcagcatactctccaaattctcctgatggatctacattgtaacggaagatcccattttctaaaaaagtaattttccctgcgattgcaccgttgttgtaagaaatattgactacattaccatcaacatttactgaatcaacagtttcaagttgaccgcgaaattcttcagcagctcttactggtcctgttttaactgataccactgtactaaatactgttgctaaagataaagcacttaatccaactttttttaataatttcattttatcctttcctttcataatttttgaattgttctaataacttattacattgacatatcagacggctttatatatcatgtaaaagttataagcacctttcaatatgtattaatgtgtgattgtagcgcttatattgtactttttttcacacatttcactatttataataatctttttttttatttttacaatacatctcaatgtttctaaacaattaagacaaatttattattaaataatacaaaactacaattattcaaatcttttaatataaaaattcttaaaatatgaatatattattattttttgatacgtaaattactaaaaataaaagacttcaaaacaatatttattagatgttttgaaatcttttttcatacttactttaaatttttcttcaaacctaaaaaagattttaaataaaatacttaattactatttttataatataaattatgaaagtctatttttaaaatcactatatccaaattctttgattacttttaatttatctttttgttttaatataatacttggcaaattcatgccattaaaagtattattcttaaccattgaataaattgccatatctttaaaccataattgctggcctagctttaaggggtgatcaaaagaataatctccaataatatcccctgctaaacatgtagatcctcccaaacgataagtatatttctttttgtcagctttagcactattaataatatcaggacgatatggcatttctaaaacatctggcatatgacaagctgccgatgtgtccattatcgcgatattcatcccattattaacaatatctaaaacactagaaactaaaaatcccgcatttaacgcaactgcctctccaggttctaaataaacttcgactttatacttttcttttatttcattaattatatttatcaatgcatctaaatcataatcatctcgtgtaatatgatggccaccaccaaaattgagccacttcatttgatgcaaatattttccaaacttggcttcaacagctttgatcgttgtaactaaatcatcactattttgttcacaaagagtgtggaaatgaagtccctcaataccttttaaaaattcttctttaaaattttcaagtgtaacacccattcttgaaaatttagcacacggatcatatatttcgtgtcctacttgagttgaacattcaggattgattctaattccacaagaagtatttgtttttgcagccaaatcttgataacgaagccattggctaaaggaattaaaaacaacatgatcacatatagtcatgatttcttcaatctcatcatcacgataagctgcactataaatatgattttcttttttcatctcttcataacctaatttagcttcaaataaaccactagcagtagttccatccaaatacttcccaattagaggataaacactaaacattgaaaagcatttttgggctaaaagaattttacaaccagtttgtttttttacatactgaagaacttttagattcttttctaaaagttcttcatcaattaaataatatggtgttttcattagtccaccaataccggatcatgatcttcgatccatggtaatccccatttgtttaatgcatccataaatggatcaggatcaaactcctcaacattataaactcctggttttttccatttttcctgtaataataacatcgccccaatcatcgcaggtactcctgtagtatagcttacagcttgagacccaacttctttgtaacattcttgatgatcgcatacattatataaataatatattttatcctgtccatctttttttccttggaagatgcatccaatatttgtctttcctacagtacgtggtcccagactcgctggatctggcaagacagcttttaaaaactgtagaggaataatttgtttcccttcatattcaattggctcaattgatgtcattccgacattttctagacattttaagtgtgttaaatagctttcaccaaacgtcataaaaaatcgaattcttttaattccaggaatattgattcctaatgattctaattcctcatgatgtaataaatacatatcttttttaccaacttgagcaaaatcatactctcgtttgatttccattggtttagtctctacccaatgtccatcttcccaataacttccattagcagatacttcacgaatattgatttcaggattgaagtttgtagcaaatggataaccatgatctccaccattacaatctaaaatatcaatataattaatttcatcaaattcatgttttaacgcataagcactaaacactccagtaactccaggatcgaatccacatccaagaattgctgttaaacctgcttgttcaaatttttcacgatatgcccattgccagctatattcaaattttgctgtatcttcaggttcataatttgctgtatcaatataatggcagccagcaatcaaacaagcatccatgatcgtcaaatcttgatatggcaaagcaagatttaacactacctctggtttaaagttcttcatcaatgctactaattcatcaacattgttagcatcgacttgtgcagtatgaataattgtttttgttttattctgtaattcttcttttaatttatcacatttactttttgttcttgaagcaatcattatttcttcaaaaacctcactattttgacaacatttgtggatagctactgaagcaactccaccacaaccaataattaatgttcttttcatttatttttctcctttatttatcgctaataataattctcttaagattttacaagctaaagcagttgaggctccactttgatcataaactggtgataattcgttaatatccattgctacaatatttaatttacttactttaataattgcttctaataactcatgaaaagttactccgcctgcttctggagtcccagttcctggaaaaacactaggatctaaaacatctagatcgatcgttaaataaaccggatacccatgacattgtttaacggtctcttctaagccattaaaattaaatttattcaaattagtatgttctttagcaaaataaaattcagcccgctcaccactacgaattccaaactgatgaattttatgatcaccaactaaatcataagctcttctaattactgaagcatgtgataacttttcccctagatattcatctcgtaaatcagtatgggcatcaaaatgaataattcttaaatcaggatatttatcataaactgcttctattgctcctaagctaactaaatgttccccaccaatcatacacggtaatttatttgcttttataattgttctagttgcttctttaatcatatctaaagctctacgtggattcccaaatggtaattctagatcaccaccatcaaaaactttaatttcttctaaatctttatcctggtaggggctataagtctcgattccaaatgattcctgacgcattattgatgaagcaaatcgggttccaggacgatatgatgttgtactgtccattggtgctccaaaaacaacacattcagcttcatcgaaagaagcatttaaaccaatgaatgtttctatgtttttattccacatctctaagtaactcctctacataatttggtaaagcaaatgctcctacatgtatcccaggattgtaatatcttgtttttatatttaaatctttccacttatttttttgaaaatcttttataggatgatatttttttgaggcaaagccaaataaccagtgtcctgatggataagtaggaatgtgagcctgataaaccttcgaaattggaaaactttcaacgattcgtttatgagctcgctgcattgctatcgcatcttcttgataaaacggactttcatgctgattaaccatgattccagtttcctttaatgctttgaaacaatttccataaaattcttttgtaaacaaaccttctccaggtccaaaaggatctgttgaatcaacaataatcaaatcatattcatcttctttataacgaacaaactttaagccatcctgataatatatatttaatcttgaatcctcaaaacagcaggctgttactggtaaatactttttacttacttctacaacgagctcatcaatttctaccatgtcaatcttttcaattgtcttataacggcataattctctaattaccccaccatcaccagcaccaataactaatactttttttacatttggatgtactgccataggaacatgaacaatcatttcatgatagataaactcatctttttctgttaacatcatatacccatctaaagctaaaaaacgaccaaattctttagaatcaaatatatcaattctttgaaattcactttttccactatataattgacgatcgactttaattgaaaatttcactcctttagtatgttgctcactaaaccacaattccatcattttcctccttcttttaaaacattaagattattgatttccatatcctctggtcctgtcataaaacatcccttttctttagcatattggatatatcttaaaatttcttctgtaattttttcacctggtgctaaaattgggattcctgggggataacacataacaaattcactacatatccgattagcacttttttctattggtaatgattctttatcaccataaaaagctttttgtggagaaataattacctccggattaatatactcatgatcaagcatgcccccacgatcttttttaaatcttcttctaatttctgataaggcaccaacaagccgttcaatattagcttcactatctccaaccgaaatataagctaaaatattaccaatatcgccaaactcaatctgaatcccatattcatcgcgcaataaatcataaacttcaattcctgctaaaccaacatctaaagtaaaaatggataacttggtaacatcaaaatcataaacactatcaccattgatcaactctttacaatatgcatagtaatcgccgatttgattgatttcctgtcgggcataacgcgctaaattcctgactttagcaaaaatttcttttccatttaatgctagatttttacgagatatatctagacttgccattaataaataagatccactcgtagtttgggttaaattaataatttgtcgtacataatcagcatttacattctttcctaacaacaaaaacgaactttgcgtcaaacttcccccagatttatgcatactaacactcgccatatcagcacctgcttccattgctgacaacggtaaatcctcactaaaataaaagtgtgtaccatgagcttcatcaactagcactaacatctcatttagatgtgccaattctacaattgcctttaaattagaacaaatcccatagtaagtagggttattaacaagaatagctttagcatcaggattatcagcaattgctttttcaacctgactaattgacattcctagtgaaattcctaaccgcttatcgacatcaggattgacataaacaggaactgcgcctgttaagatcattgcatttatcgcactacgatgaacatttcttggcatgatgatcttctcccctgctttaacacttgccatgatcatactttgtactgatgaggttgttcctcctaccataaaaaaagcatgagctgcattaaatgcatcagctgccaagttttcggcttctttgattacggaaatgggatgacataagttatctaaaggtttcatagaatttacatcaacactcatacacttttgtcctaaaaaatcggttaattctggatttcctttaccatgtttatgccctggaacatcaaatggcaccaaacgctctcttttcatttgctgcaaagcttcataaataggcattttattttgatctaatttcacattataacctcctagaaaatattgctcccactatagatttcaatcatttcctgacgtaaattattagttatttccaaccttactttaggtggcagttcatatatatctgttttaaacaaatagttctgtaaatctatttctttaatcagcattttagtatgaaacagatttgcttgataaacgttaatatctgtagcatcatacttattcaatgtttttacatcaataaattgttgaattgaagcaattggattatctataaataatttctttccctttatatccctagtaaacccgcgaattcgataatccatagtaatgatatccgaatcaaaattagcaattaaaaaatcaagtgttgataatggtgaaatttcaccacatgttgctacatctatatcaaccctaaatgtggcaatgctagtttctggatgatactcaggataagtatgcactgtaatatgactcttatctaaatgtcctaaaatcactcggtcatctaattcctccattttcccttgtcgattcttcatcatattatcttctgctaataacatggttacactggcgccttgaggatcgtaatcttgtttagagacatttaatacatgtgccccaatcattttagcaacttcatataaaatatccgtcagcctttttgagttatactgctcatctatatatgcaatataatccttttgttcacgttgacttttagcataacatacatcataaatattaaaacttagtgattttgttaggttattaaaaccatataattttaacttctcattcataccagttcccctttttcaaaataaaaaaatcaagcaggtgcaatcccacttgattatcaatacattaaaaccataataagttctattagtttattagtttcagagtctatatagcaagaatcacttttactactcttattgattgtttcacaagtgtgatgtgcctaaagcacacggttgtatagtcaccaactcaatgtcaattgtattgacatcaacttataaaattcgaactttcgttctatcaataaggcaacaaagttgccatctagcatttgatcaaataatttgaatcaaaaattctcgcaaaaataaactcctcttttgcttaatatcgattatatcttatcagtatgtaaaatgcaatatattttttataaaataaaatttattgtttaatatagtaaacaaattcccgttttaacgggaatttgcattaattaactgttttcttttttaccacataaaataacaatattacagtcattaaacttccaactggaatccatatgttcatcatatcgcccgtattaactgcttcttttcctggaatatcacttgataatatcgctgtttcttcagaaactgttacaagctcggcaattgcttttgttaaaacatcttttgtagtatctacttgatcccgtgttgcttctggatcttctaataccgccttggcttcatttaaagcatctgcgactactgcccatgttttagcactatagtttgcagcgtttaagctatttgccttattgatcaattcttgtaataagtctttgtttggtttcaatcttaagttcaagaaagcttttactaattctgtatatacttcattaacttcaccttgcattgcattaacatcatccaatacaacatttgctttatctaatgctggtaacatattagaccatgaggattcaatgtatttactttcatctaaaccattgatttgatctacttgtttttgtaatgctgttttgtcacctttgtagaattgtaacatctgcattacatttgctagtcgagcaaaggcgttatttacttcaacttgtgtagctttagtattatcatatactgttttagcgtttgttaaagcttcattgaattcagttactacggctggtacaacattttctaaatttgctttttcagccatttcaatagcaattgataatgcttttttatctgtagctgcttctacatcagttttcactaaatcattaatagcattatctaattctatggtcatttgatcaatttcagcttgagaatatctattcgctacaaaactctttgcttcatttaatgtattctctaagattgtataagagtccactgtatattcatctctgtttagattttcagcatcattaataagttccattaattgtgaattatcacctgctgttacaagctgatcaatgcttaatgttaattgttcaagaatttgatttacatcttcctgagttgcgtttatatcatataatatatcttgtgcctgactaactataccaataagtttatcatagctcatactcgtaaaatcattttcatttaattctactgctttctgcaattctatcgttaaactgctaaaatcagttagcgattcaacttctttatacaagcttatttctgcaatagctccaaatatatcttcgttagcagcatttaccccatatgaactatttatatttattcttaaataacgagcagttatagtagtatcaaaattaattactgtagttccatctttcttcattgttccactatctatttcctgccaattttcatcatcattacttatttcaatagtataatctctaatacttccatttccattacgacttatatattctaatttatcgaattcaacttctttagccatatctaatttaaaccagtgtggacattctggcttgcttccaatatattgagtatgccaaaaagttgaagtattatcatctatagcatattgggctggcccttcatttgatgctccacttgtttcaactgaatctgctgttgcattccatgctgttttatcaagtttgatatcatcatttgtcaattgatattgtgcatattgttgttcaacttcatcatagccaagcgcccgattaagaatttgaatatcaccaacatttgcatttaaattatcagcacctaatattatctcattctgactaaattctttttgttgtcccttttgataagaagttgctgctaattcactatcgatatacatttttatcatgccgtttaattctctagtaatattaatataatgaatatttccgtcattgatttttccaacctcttcatctttagtagtagtcggaacataactgtcactaccaaatgtaccgtttgctttttcaattactgtagttattgtttgtttagaagatagagttgttgtttcatcttgatagatcaaatacccattttcatcgatccttaattcataaccattttcttgttttaaaatactactatttttatcagctgtttgaataagcatagaaatactataatcttttgtatctgtatcaaatgcattatttgtatttagtttatagctatgattgtctaattgtaataattgttgtctatttcgatcaaatgtctggattttaatttcttcaccatcaattaaatcattcttattttctacttttgcaataatataatcttgatatgctttaaaagaaatatttttacttaaacttacaccatttaatccttttagatcagctatctctaaatttatattactatctttagtgaatttctcgctagttttgatttcaattgtacgatagtcagctaagatatttgcttcttctacttttttaccattgactgtaaacttatttgcatcttccactcgtttattaaacttaattcttaatgtattgttgtcaatattctttacatattcaatttctggtgcctgatcatcttttaaaccatattgataaatacgtgtttcataaggttctaaagtaactgttacttcatcaccatagcttactttaacattactagtatctgatgaataaggaagaatctgactttgttgaagatctttcatatctgttggtaccccaactagatcatttaaagttaaggtataagttttagttgtgtttgtaggatttctaaacgatacaattccttcatcattattccatgaagaatagccatatactgctttttgtttaggagcgcttccaaataatttagcattctttaaaatatgataattattttgtgcaaactctaacacatctgctgttacctgccatttttcttcatccattaaacttggtgaaaaatacaattcccaaaatgctgttcctcttacagcatttgacatcatatactgacggaattcatctgttgtcatcgttactcctgcagacactccataaattggatcatgattataaatattttttaatggaaactgtaattgagcagtttttacattagtaaaatagatattatcacggccactaatcattttttgtgctgaagttccaccatttgtagaatctaactcattgtctcctgcattttgtaaccaaactgtatttacccattgtaagatccacggacttgggtttacataacaagttgcatttataaataaccctttgccttcttttgctctttgagctctcattgcttcaaaagtatcggtccagttttcccataaatcactagtaaaatacatgttattataaccaccagtcatgtggtcatgatcctcttgaacacatggtcgagaggcaaaaccatctaatttccagtaatctatatcaaagcgttcttgataatcagtaaataagtttgttaaattttcaatgtattttttagaaccagtacaaataacttttcctaacgctgcagttggatgcacatatccagttccctgactttcaatatactgtgcaaatgtatcctgtaattcataaccaccctgtgggcctaaccaaactccaaaactagaactaaaatttcctaccatctgcttagccgtataaaattcgtttggaaatttatcattaaattcccagaatcctgtctgattataagatgatcctgagcgactctcatcaattcctgtataagttggatcattataattattccatccatcatcaacgacataagcgtctaatggttcaacaccattttgagctaatcctttttccaaaccaaaaaaacatttttcaatactttcatcagtaatagccattcggttatcataccacgaattatattgttttctaaaatctgtttcagttgcaatactatcaatataagcaaagaaatctgtttgtacaacatcactttcaattccttgggccgctcctacgacattaggccaggtaaccatcttgccatcagtcgttaatttattttcatctcttaattgttttaacgttttacctgaataataacgtatttgcatttgattattaactacttttgtatcagtagctggaaattctgaaccaaaaaataacccttgagcatatattggctgtcctaacaacatttctgtttcttgaaaactgtatgctccagcattaactttaaaattatctggccttgaccaaatacctttagtatcatcagaaaattcgaagtgatcaagatcaatataatcaattctagccgtttcttcatcatcaactttagtttctaaatatgatctcataaaatgattatcattttccataactacaatataattaatatcccaattaatatcattaaatacatatgaatcaaattcaaaagtaacttttttcccgttttctaatgaatcaaattttatattttttaatgttagatcactttctctaataattgtttccggtttaattgcctttgtatatgcatcctcatataatctaaattcagatccacaaaaagttgctaactcacttaaagaacaagaattagttatcaatctaacatatcgcgctgtatattcttgatcaaagtttgcataaactaaatcagcaacattgtataaaccgttaactacatgcaaattataatcttcccttgtaaattcaccgctaccagcttctatccaattatctccatcactgctaacttgtaaatcgtattttccaatcgttccgttgattccccactcaacattactatttcccgctcttttttgaaaagaaaaagaattaaaggtctcttcctttcctagatcgactgttaaaatatatggaaaatctgtttttgtatcataatattctgtttctgtagtgtcattaccatcaaataaatttttagcatctactttattactgctcccttgtcccgttacgtagccattccatctactgcgatcaatttccttaaccggttttacatctgtatcttctgttaatacgattgtattgattagaaaatcttctgatcccacttgtggaactaatatttctttaatccttttgttgactatgctcgctgttgttaaatgattttcctgaatcataaattctcttgaaatatattcgttttcaataattacctgattttcatttcgtttaacttcaacgtcactttgggcatatacattaaggggcgtatactgaaaaaataatgctaaagtcaatccggttacaattcctttttttaataatttcgactttatcataaatacctccctgataccaagagattggataaaactattttttagttttatcaatctttttacattttttacctccacagttacttttttactggaatttaggcgcttcatgatgttattcaggtaaataaatggaggtatattggtttatttttgtcttcaaaaccttgaataacaatttccttccagtattactgatcaaaccttcttacttctttatcaattatttaaacttttctattaaataacacttataacttttaatctggaaaatagaacctacttcaaatttgatatcaatattggtcgtaacagtaataagaaaaaattctattttgactacttaaatataatatttctagtataataaaaaagcttagtattattcctaagtctagaaaacttttaatatctttcattactactatagcctcttttgctgtttcattaaactaaatagttcaattgatattatttgttatatttctttttttgtaattacgctgatcaacatcaataaaagaatatttactaattatttatgaaaagatcatatgttaataacgtatttagatataaaaaagaactaaacatgatttattgtccaaaaatatcattatgaatatcgtttcccgtttgcttgatagaataaattaatgttcatataatgaattttgcaaatctatatctaatttgattaccaatgaaacaattttaaatttcctatagttatagaaataaatatttaataaaatcaattataataactgctacaattttttttgcaaaaaacattaatgaaaacaaaataaaactttattattatttaaaaattattaaattccccttattttagcgcctttttttatgatatatcattgtcttcccgtattttttgatattattaattttctattttgatttatttcccctttctttgttagcggttacatttaaaaatagaatcttttctcacaacattattatgtactctataatttatttagtatttataataattagctttttattttccttttttaattcaaaaaatctagttcattaaaaatgaactagattcctttaacatttattcttgtaattgcctttttaagagctatttctgctcttaataaatctgtttgctccgttgcttgtttaattctttgttcagctcgaactttagcttctttagctcgatttaaatcaatttcttccttagattcaattgaattagcaattattttcgtttcatcatcattaacatatacaaatccaccaccaacagcaaattcataacgctgtttatcaataatgtaactcatttgcgatatttcaataccactagcaagaggcatatgatgagctaagattcctacttgtccagctgttgtccgaagatttaactgatcaatttccacttcttgatagatacctttaggtgttactattttaagcttaaatttagtcatttgctaaagtcttcgctttttcaatagcttcttcaattgtacctacattgtggaatgcttgttcaggcaaatcatcatgtttaccttcaagaatttctttaaatcctttgatcgtatcttcaacccgaacatatttaccatccataccagtaaattgactagctactgtaaatggttgtgatagataattacgaacccgacgtgctctagctactgtcaatttatcttcttcacctaattcatccattcccaaaattgcaataatatcctgcaattcttggaaacgttgtagaatttgttgaacaccatgagccacctcataatgttctttaccaacaactaatggatcaagtgctcttgatgaagagttcaatggatctacagctggataaattccaagcgcagcaattgaacggtctaatactactttagcatcaagatgagcgaaagttgttgctggagcagggtcagttaaatcgtcagcaggtacatatactgcttgaactgatgtaattgatcctttttttgttgaagtaattctttcttgtaaagcacccatttctgtagctaaagttggctgatatcctgcttgagaaggaacacgaccaagtaaggcagatacttctgagcccgcctgagtgaaacggaagatattatcaataaataacaaaacgtcttgtccttgttcatctcggaactcttcagccattgtaagacccgtaagcgctactcttaaacgagctccaggtggctcattcatctgtccaaacactaaagttgtttttgataaaactccactttctttcatttcataatataagtcatttccttcacggctacgttcaccaactccggcaaaaactgataaaccaccatgttcagtagcgatattattaataaattcttgaattaatactgtttttcctacaccggctccaccaaatagaccgatcttaccacctttaataaatggacaaatcaaatctacaactttgattcctgtttctaaaatctctgtttctgttctttgttgtgcatatgtaggcgcactacggtgaataggcatctttttaacttcattacccaaagcctcttttccatcaattggctgtcctaaaacattaaacattcttcctaatgttgcattacctacaggaacagaaattggatgttgggtattaatagcatccattcctctttttattccatcggtaggtcccatagcaacacatcgaacaacatcatctccaatatgttgagctacttcaactaccaatagttcttcaccattttgaatttcaattgccgtatttaatgatggtaaattgttatcactatcaaattgaatatctattactggtcctttagcactaattactttaccaattttttgtgacatacagcacctccttattgtgcattagctccggctacgatttcactaatttcattagtaatcgcagtttgtcgagcttgattgtattttaataataatttttctgtaagttcatcagcattatcattagcattttccatcgatgttcttctagctgcattttcactagttgcagattcaataatatatccatatattactgcttgaagatacattggaattaaactatctaatacttcctctggacttggttcaaacaatgttgatttatttgaaatctctatatcatcgaattcatcaggatcaataggtaataaagtaacaatacgtggtttaaacgttaaattattaataaattccgtataaacgatcttaatcttactaatttctttttcacgatacatttttgttaattcggcaactaatttagttacgtctttaaaatcaaatgtattatttaaatcttcaaatttatgatcagtaactcctttatgattcttcaatagataactagtagctttagaaccaatactataaacataatccccaggtttaattacacctttaatttctttaaagatattagcattatagccaccacataatcctaaacttgaggcaataactatatatacttctttttctacatcattattttcagttaaatagacactatcattatttcccttacaattagctaaaattcccgctactgttaaagccacatttgtataataaggttttgattgttctaattgattccgcgtcttacgaagttttgacgttgcgactaattccattgctttagtaattttcttagtcgattcaactgatttaattcttcgtttgatttcttgcattcctccaggcatagtaaactacccctttgtttgagttttttcaaattttgatacaaaagcactcatgacatctttcatccgtttttccaaatcactagaaattgctttttgttcattaatttcatcaataatatctctttgggtcatagtaatatgttcaactaattgatccataaaaattgatacttgttctacttcaattgttttagtaaatccgtattttaatgcaaataatgtaattacctgggtagcaacactgcgtggtgaatattgtgcttgtttcaatacctcacgcactttagcaccatgatctaatgttgctttagtcgctgcatctaaatctgaaccgaattgagcaaatgcctgcatttcagcatattgcgctaattctagttttaatgaaccagatacttgtttcattgctttgatttgcgctgctgaaccaacacggcttacagaaagtccagtatcgattgctggtctaaatccagcattaaataattcttgttgtaagaaaatttgtccatctgtaattgaaattacattagttggaatatatgctgagatatctccggcttgtgtttcaataattggtaaagccgtaattgatccgccaccattttcttcatttaaacggcaagctctttctaataatctagaatgtaaatagaagacatctccaggataagcttcacgtcctggtggtcgttttaataataatgatacggtacgataagctactgcatgttttgataagtcatcataaacaattagaacatccttaccttgatcaagccattcttcagcgatagcacaacctgcatatggtgcaatgtattgaacaggagctaattcactggcagaagcggaaacaacagttgtatattccattgcgccacctttacgtaatttttcaacaatttgagcaactgttgaatttttttgcccaatagctacatatacacaataaatattttgacctttttgatttaaaatcgtatcaatagcgattgctgttttacctgtttgacggtcaccgataattaactcacgttgtccacgcccaataggaataattgcatcaattgatgtaattcctgtttgtagcggctgatcaactgattttctagtcataaccccactagcaactctttcaattggacgagaatgagctgtaacgatttctccattaccatcaatcgcttgtcctaaaggattaacaacccttcctaacatttcatctccaactggtatttccatgatctttccagtacgttttacttcatcgccttctttgatcgtactttcagatccaagtagtacggctccaacactatcttcatctaaattcataaccatcccatatacatcattaggaaaagctagtaattcacctaacatggcattatctaatccatgaattaaactaacaccatctccaactgtcataaccgtacctacatctttaagttcgattacatcatcaaaatgcttaatttgttctttaattaaagcactaatttcatctggtctaagccccactattttcacctactttcttaatagttcttttttcaataatgaaactttgtttttaatagagccatcaaaaactcgattatttatttctactttaattccaccaatcaatgatggatctttaacaactcttaaatgaattgttttattttcttttttacttaaagctgtttcaacttctttaacctctgcttcactaatatcataactggcatataaaacaccttcttgaattccaaaatattcattagttaaagatttgaacgctttaattatttccataacataacgcattcttctcttttttactaaaagttttaaaaaattaacaacataatcattaacctgacctttaaaacttttatctaataaagcacatttagtctcatcgtcaattaaaacatgactaaagaatggaacaaaatttggatcactttcaaaaacttctctaattaaatcaatatctttaacatatgcttcaatttgattcacctctacagctaaatcaaacaacgattccgcatatctaagtgctacagcttccactagttaaccacttcttcaacaaagtcttcaactaaagccttgtttgtttttgtatccatatccttgttcattaccttagtagctacatcaattgcaatttcaacgatttcttgcttcatttctgctttagcctgggctttttccgcttcaatttcgcgacgcgcttgatccattttagccttatattctttattcgcatcttcctggatagcagttttcatctttatagcatcctctttagcctgagctacaatatcacgatattccatagcggcttgacgtgcctgtttatcactttcttccatcaaagctttagctttagcattcatttctttagcttcattaacagttccttcgatataatcagctcttttagcaaaataattttgcactggaacccatagatattttttaaaaacgaagaataaaacacctgttgatagtaactgaacaataattgttgttacattaggaaataattttatttgaatatcaggcatagatattcctcctcaaattaatatacgaataataaaatcaatgaaatcaataaaccataaatagcagcagtttcagttaatgcgatccctaagatcatcattgttctgattttaccttccatttctggatttcttcctaaagcttctactgctttacctgcacaaataccttcaccaataccagtacctaacccagcacatactgcgataccagcaccgatagcaattaaacctacatttgtcattaatatttcctccaatatttctattttttctatattctaactagataaatctaggttagagcttattcatcgtcgtcactattttccatcataatcaaaattgatgataatgtaacgaaaactagagtttgtatacatcctgcaaaaatatcaaaataacagtgtaatgcaggagcaatgataggacctaaaaagttaaagtttataacatgatatgatatccatgctgtaaactgatatactaaggccattaaaatcgaaccacttaaaatatttccaaataaacgcattgaaatagaaatcaatggtgatatcgtacttaaaatattagttggtggccaaacaacatcccatatatatttaaagaaaccttttttctttaaagcattatattgaattagtacaaaagtaataaatgtcattgtcaaagttattgagaaatttgaagttggcgcttcaaacccaatcaaactacttaagttactaactaatatataacaaaataccattgcaaaatatggataataattctttgcgaacttcttgggcataattgtcttcatataatcatcaaatatctttacacctgtttctacaactagaactattcccttaggtttagcagtaggatcggccatagctaccttttttccagcataaacaaagaaaatacctaaagctatcatgataactaatgaatatattaattctgcctggataaccacttacctcacctccttattggcgatttaaaaagcctaaaattccaatcgtcattctaattacaaaataaccaaaaaatacacttatcaagttaaatatgttatctaatttaatcgccaggataaatcctccggcatacaacaacatttttaaaatgaacatcattactacatatttaattgtctgtcccatctttaaaataaaatcggacattaaaataataatataaaaagacaaaacactaacaatatatcctaggataaaccccaaaggaaaactaatttgttttaagatcattcctatgataataaagattaataatccacctataaatacttttacagattgttttaaaacatctctttcattcatcgttttccagctcctaaaagtatctttatgacataaccaaaagctacaaatagcagtattagtaagatagttggtcgcgttttaaaatatttatctaattgcattcctataactacagccaacagaaaaattccaattatttgcaaacccaactgtaaacaaaagaatagatcctttaataattttttcttttcttgattcatatgctaattatgtaactttcgataaaataatattcaattattaatcagttccaaataaacgatcaccagcatcccctaaaccaggaacgatataaccatgctcgtttaacttttcatctaatgctgcaagagtaatattaacatcaggatgctctttttcaattaaagctacaccttcaggagctccaaccagacaaactaataaaatattttttgcaccacgttctttaatattttgaattgccattgaagcactgccccctgtagctaacattggatcaacaacaatgaccaatgaattttctaaaccactaggaaaacgcgcataatattcatggggaataagtgtttcttcatcacgatacattccaatatgcccaatctttgcagttggaataatatctctaaaaccatcaaccaacccaattccagcacgtaatataggaactaaaacaatttgctgatctatttcttttcctaccatttgacaaacaggtgtttcaattactttatctctaattggtacatttcttgttacttcataagccattaatttagcaatttcatctaaattttgtttaaatatgtatgttgatgtgtttttatcacgcataatcgtgagtttatgcttaattaatgcatgatctaatactgttgttgccatctattatcctcctaaatatactttatatctttatacattgtcactttatcagttaaagctttcactcgttttaagcattcttctttaacttcatctgtttcttcattttttaaacgataagcaataatcttaccaacttctttaaaatcttcttctttaaaaccttttgttgtcatcgctggcgtaccaacacgaataccactggctttaaatggtttttcagtatcgtatggaattgcgtttttattagctgtaatattaatttcgtctaataaacgttctgcctttttacctgagattccacagcttgcttttacatcgattaaaatcaaatgattatcagttccattagcaactaatctaaatccttcttcctttaatgatgtttctaaagctttagcatttttaattacctgagtggcatattctttaaattctggctgcattgcttcataaaaacaagctgctttagctgcaataatatgcattaatggaccaccctgcatacctgggaaaactgctcgatcaatagcagcagctaattctgctttgcacataattgcccctccacgaggtcctcgcaatgttttatgtgtagttgttgttacgatgtcagcatgtggaaatggtgaaggatgtaatccagcagctaccaaacctgcaatatgcgccatatccaccataaataaagctccaacttcatgagcacatttagccatgtattcaaagtcaataattcttgaataagcacttgctccagccacaactaattttggtttgatttcttgacatttttctctaaaatcctcataatcaatagtttcagtttccctagttacaccataactatgaaactcataatttattcctgaataattcaaaggatgtccatgagtcaaatgaccaccatcagctaaagacattcctaaaactttatcaccatgatttaataaagccatgtaaacagccgtattggcctgagctccactatgtggctgaacattggcatactcagcaccatatattttacaaagtctttctctagctagtgtttccacttcatcaacaaatttacatccaccataatatctttttccaggatatccttcagcatacttattggtaagtacacttcccgctaattctaaaatttgtggtgaaacaaaattttcagatgcaatcaactcaatgttgtttctttgacgatttaattctctttcaacgctttcaaatacagcaatatctttcattttattcttccccctcgtaagccatcatttttgcaattctttgatcatgacgaccaccttcatattcgccttcaagccaggctatcaaaatttctaaagctaatccctcaccaataactctttgtcccatagcaagcatattgctatcgttatgagctctggtcattttagcgctatatacatcatgacatagtgcacatctaattccctttactttatttgcagtgatactaaccccaatgcctgttccacatacaacaacccccctgtcgcatgtgccattggctactgctttcgctgcttttcctgcaaaatctggataatcacaactatcttcggtatatgttccgaaatcttctactgtgtaaccattagtttctaaatagttttttaaaacattttttaatcttaatccaccatggtcacaagccatcgcaattttcatttaactacctccgtgatttgttcctcagaaatatcaccaattcgcaatatctctattttacccttacttaaatcaacaatcgtactagcctttttactgatacattcaccttcaacgatcattggaatcttaccatcaaatactttttttacagctttatcatcaacaagactagcttcaccagacagattagcgctcgttactaacattggtcccgttagattcaataaagctaaaacaaatggatcatcaggaatcctaattccaatcgtatcaaggaatgctgtaaaataatcatcaataaacgggcgtttttttaaaatgatagtgatcatgcctggcataaaagcatcaataatttttttggctgcttcattaacataagcatatttttcaatatcttctggcttagcgatcatcattgaaatcgccttgcctttatctcgatgctttaattcatataatgcatctaatgcctgatgagagccaaatttgactcccaacccaaaaacagtttcagttggaaaagcgacaactcgattatcgctaattaacttagcgatttgttctatgtcttcttttttaaccgaaactgtattcatgatatcacctcatttgccccattatacaataaatatttataaatttgtagttattttatagatattttaagtatcataattataacttctattttacctgccatcgacattctttcatatcaacattaccattagctttaaatttaactccttcttgtaataacaaataacgttgctcatgccagtttggtaccagacgtcctgcactgtttactacgcgatgacatgggtaattgccatacagtgaagaaaaacttagaatctttcctactaaccgagcattatgttcacgaccagccaacgttgctatttgtttatagctagctacttttcctttaggaatttctgatacgatcgctaatacttgataaatcaaatcttcattcatttgtttctcctctttgcttcaatactgcattttataaaaagtttataacctattttaatcctttttttacaaaatttcatcattttttaattaaaatgacactctaaaagtgtcatttaatttttacatcgataaatttttaatagtttatttaaatcttcgatccgttcacttatttcaagtccttttttagtatctttaatcaattcctgaatttggcgtgtatagatgatttgagaatcatattccatatcattattgatattaaaactatattcttgattaattaaatgtgtttttaaacgcattccatgactattagaaatcaaagtatatcctgctacacctgtttttccctgatactgtaaacaaaaaccaccatcaattactacacaatgattatttcctttcaatgggttttcaccatctttgaccttaactggtgtatgtccgttaataatcatacttacaggatcatgtaaattaaattcagatagaatctttaaacaaattttttcatcattgatataatgataatatggatctttaacttcttcttgaggatcatctaaaacaatctttcgaccacatagtggcgatttctttccacaccacaaataccaaaaataatcaattatttctggttggggatcattgaaagcttgatgaattttatgatcaacttcatcgaaatattttcgtcctgccaatttttgaccaaaacaatcatgaatataaaaatcgcccttttcatctaatggtacgcatccatgaagcaaaagattatgattagtctttaaatataatgaaccatgttcataaataaattttatgtgcttttttaaacgcttgctactagcaaagctcttttttaaatcatcaataataaataattccattttgtctaatggctgagtatctgggtgactaacacgataagtcatttgccattggggataattattaatcagtctagtttcaagtttatttaatattttcattactaacttttccatcgcctccaaataattaatatctggataacactggctggcatgcatcatcaaaattcttaatggaatcccatagcttttttctaaaaggtcaatatttcgatatttaagacaatttttaactaccgtcataatacaagctaaatttcctagataagcccccatccacaaaatatcatgatttccccattgaatatcaactcgcttatactttattaaatcatcgataattttatctggttctttgccacgatcaaaaatatcccctaatatatgcagctgatcaactgcaaaatgtttaataattttagtcagactttcaataaaataatcttgttcaccaagctcaatgattgaatcaataatatggagatgataaacatactgctgatccatttcatcgagttgtgcgtgtaataattcatcaataatttctgaatactcgttattaatattatgccgaactttactgcgtgtatacttagatgtaatataacgtgctaatctaattaaacgtaaaatagattctttataccattgttgatcaaaatttttagcagctaataattttcgaggataataaacaagataacatagttcattgatctgctgtgaagttatttcctgactaaaaagcaagttgactttttctttgattacgcctgaacagttattcattaaatgtttaaataatttatattctccatgtaaatcagaaatgtaatgttctgtccctttaggtaagttcagtattgctttaagattaattatttctttgcaaatagcttgaatcgttggatagtctttagctaaagaagacaaatatttttcatcgatacttagcataatatctcctttatttaaataggcttatatctttgatataagcctatgcgtatgattatttataatagtttaataagattttttctgcttcactgttccataagcctttagttttcttagttgcctgggctaattgtttaaataaatcatttgtttttcccaattcttcaaaatcatcaattgctgttaaaggcatttcaatatgagtgtaaatcaattttttaccacctggaatatttggtagatttttagtagtttcagcaacagcatctaaaccaccgatatgcgtaatcattacggcactattgatcaatcctttggcatctttatcaatagcttctttcatatcatcaatcgttcccccagtacttcctaaaatacgatgtcttgaataatggcaattgtataaattcatattggctgagaaattaggatctgttggtccagcaaataagtttaaattaccgtcataagccaataattcatctcctaattcagaaactgctttattaggaatataaacgaaaacatcatcataaccttttccatcagtaagtgctaataattcttctttttgattttccatatttgcggtattgacataatgtaattcaaccccatgtgcagcagcttcttcaactgagataacttctttagcacgagcaattctttcatcagaaatttctgtaacaactacacgtttaggtttattttcataagttaaagcataacttacagcacctaatcccattggtccacatccacctaaaattaaaatattaccgccttctttagttcccattacatgatcatagcatccaggaactgtatgataatgagtatggaatcctgaaatgacacagcacattggttcagctacagatgctgcaaaataactatcgccttcaaaagtccataaacagtccgcttcaatgatatcatttgggaaaatacagtattgtgtatctcctccacaccattgataagaatatcctggtgattccatttgaccaggaattgctggctgttgtgcaaatttttgccctggtttaaatttatcttgccatttttttccaacctttacgatatctccagcaaattcatgtccaataataattggattatcgtaaacatcattaggtactcgtttatgattagcaccttgtttaatagttttatatgttgacatacagatactatctgaaactacttttactaaaatttcatcatctttaatttctggtaattcaaattcttctaatcgtacatcatctacaccatataagcgtaccgcttttgttttcattttttctctctcctctatctaaaatcaatttcgacttctttcattaacatctcgacaacactgcgacttggtgcttttgttcccttagtcattacagctccagctgaagtagcaactgctaatttgatcaatggaattaattctaaatcttcgctaattccatatgcaagagctccaaccattgaatctccagccccaacagctgaatgggctattatatttaaaccttttacatatgctgtttcttcattagtgataaagattgctccccttgatcctaatgaaataacaactgtttctattcctttatataataattttttcgcatgacttactaactcaacatcattaacttcttcagatattccaaagtatttacataattcatacttatttggtttaatcaaagtcggagaagcttttattccctgggtaaatagatccccatcggcatctaaaataactttcgcccctttagctttgatcatcgtaattaattcttgataaatagttactggtacgccactaggcacacttccagctaaaacaacaatatcatttggcttaaccatttctattagatcttcttttaaataacgtagatcattttcactaatttgatctcccgtatcatttaattcggttaagttcatatcacgatctagaacctttaagttgattctagtattaccttctacatgtctgaatttatattctaatcctaaactatctaatttatcctcaatccactttccgttactaccagcaacaaaacctgtacaaatagattttccgcctaattctttgattgctttagaaacattgataccttttccaccaacatcaagaataatattatttaaacgatttaatccattaggaatcattttttctacatgtgctgttttatcaatagcaggatttaaagttactgtaattatcatgattattctccttttgttaaaacatcatatatacgatcaatatctttacatgctactaactcatcaacagtactcatatcacttaattttaaagcaatatttgtaagaatttccatgtgatcatcacccttagcagcaattccaattacaattcgggctttattaccattccaattaatcccatctggatagatcattactgcaattccagtatttttaacatagtctttgacatcatattcaccatgaggaatagcaagatcgttaccaatataagtagttaagtcatgatcacgatttaacattccctggatatatggttcttcaatatatcctttatccttaagcagttttcctactgcaataattgcttcatcactagttgttgatttacaatctaaaacgattgattctttggctaaaatactattgttgtccatcatttcatttatctccttcgctatttgttgaagtctttgatcatctaagaagttatctatggcatatacttttaaaaatcggtattgattctttatagaatttattaatgctctttgtgagattacaacattacagtcatagggaatttcgtatattgcacagttagagacttttacgtcaatggaaacaaatttttttagtaggctggcacccaatgcactagatcccattccggcatcacaggcaaaatatacgttaattctagacatctgttattcctcctctttaattacattaataataaatttttgtagaacatcattaaatatatcagcaagattttcttgatcactttttgctagattatccaagaagttatcatcttcaattaacatcgctgaaacatgtgacattagtcttttttgaatttgtgtagctttgctaggtaatagcattaataaaactactctgatattatctaattccttatttacaaaagttttttgatcaggctttaaaatttttattatacattgattaattaaatctgttgttgtgtgtaataaggcaaagccaaatgagttataaatattacttcccttactttcacgttcttttatttgcgtcactaagattggatcattagatacttgttgacataatgtcaaaattacgttttctttattagcgttattggggatgctggtaattgtcagattatcaattaagtgtttgatattatctaatatttcaattagattgattgacgggtattgtttattagtggttatgggtttttgttgccgtttatttttaatagcttcaattacatttgcaacatcattttgattaagtatagggctaacgattatggcttctttaattgcaaaagttgaaattaataattcacagttattattatttatctcactaattgataatgggacaagattgacatttttatcaacgattcgttttaatcttgctactagtaaagcagaaataccaataccactgctgcaaacgatccctacattaatcgggcgttctacctgatttaacttgttgcgctcgattgctgcagcaaagtgtaagactaagtagccaatttcatcttcatttaatgtatagttatatgtttcttcaaagactttacaagctttttgcgtaatttcgaatatttcttgataactttctttaatttgttctaacattggattataaattggtaaattatattctaagcgaaccattgccggctcaagatgagctgcaaggctttggtacaattcataatcactatataaatttatctgatactcattaaaaacatttaacattgccataatgagatcatgatattgttcaacttgattttcatcatctttaataattgctgatttagcactttgaagatgaatagctacaaaagcacattcagtatcttcaatggtaatatcaaaagcttttgctaaataatcaaccattatttgagcattttgataagctttacgatcattaattaaattaaatatcgcccgattatcttgtaatgcttcaccttgtttaattcggttgatggcaatcattaagtgtatcaataagcccatgtacgagctttttgccatattatctaaattgagttcttcatgatgcgttttaaagacctctaatataatttttaatacatcataatctaatagtttattcatattcgaatttttagtaactgaaatttgattgattacatcttggatgttatagcgatcgaagtcaacattcataatatgatgctgtaccgtattgttgataattgttgaaatggctctacgaatctctgactcatcagcttctaaaccaactccgtatccgggtcttcgaatcatctttatatcatatttagcaaagaatttttctaaatcatcaagatcatgagaaatcgttgcttcagatacttgaaacttattactatagtaataaagtttctggatttcattagcatgtaataattccaaacaaagcaactcttggcgttcttctttatccatgtaatcaatttttgatccctgaatatccattattagattttgttttgcttcttctgttcctgatattaagattccttttcccttttttgaaaggatttttaaattcattttttgtaaagagttttttaattgagatagttctcgcataattgttcgagtactaatgtttagttgatctgatatttcttgataagtgatgtaatcatctcttaataaacatattgataaaatttttgcttcacgagatgaatacatcatctttacctccaattattttaatttattaactatttcatcatattcgctgccacccataaaattagtaattgggaagactacaacgtttggtaaatctccttttacccgactgaccaacgattcatgagttacaactacttctgtatctttgggaatatcattgattgcataatgtggcacatcgacatcaatacctgctgcttttaatttctttgtaagtaaagcagctcccattgcacttgatcccattccagcatcacaggcaaagacgatcttgcgtaattgattatatgcaatttcagtttttgttcccttcatttcttgaacttgagtttttgttgtttctaaatcagcatcattgtttttatttctttttaaaataattgatgcaatgaccatagaaacggcagttgctgcaattacacttaaaattaccccgatataactgcttcctttacacattcctaaaatagcgatgatacttcctggagaagctggagaaactaatcctgaatcaaagattacattaactaagacacctgttgccccaccggcaatagccgctaaaatcaaagctggactcattaagatatatgggaagtaaatttcatggatacctccaaagaaatgaattattgctgctcctggtgctgatgatttggcactaccttttccaaagaagcaatacgctaataaaattcctaatcctggtcctggatttgcttcaatcaagaagaaaactgattttcctgtatctaatacatcttgaatacctattggtgaaaaaataccatgattaattgcattgttcaaaaataacacttttgctggttcaataataattgataccagaggaagtaatccatgttcaacaaagaaattaactccggcagttaaaccatcgtttaatgctaaacatgcaggattgattgcaaaacatcctagaatcgctaaaaagaatcctaaaattcctgctgagaagttattgactaacatctcaaatccttgtggtgttctatcctttaataattcatctaattttttaattaaccaagctccaagtggtccagcaatcattgctccaataaacattggaattggtgctcctacaagaactccaatcgtcattattgctccaactgtagcccctcgttgtccatagacattgtgcccaccagtgtatcctatcaagataggtaataaatacttattcattggctcaattagagttgctagggtttcattaggtaaccaaccatcttccataaaaaatgatgttatcagtccccatgcaatgaatacagcaatattgggcataaccattgcacttaaggcgcgtccgaatttctgtaatttttctttcatcgttttttcctttcctttcctctttacaactcttactatacatgccaattaaagcgttttcaatttaatgaaaatgaagtttgtcacttgtataaaatgacaaaatttaagagtcttggtaggcttattgtttgacaattttttacttttttgctcatatcatttttttgctatcttttattatacgatagttacaaatagttgagaacaactttatttacttaatcaaaaatcacctaaattattagccataaatctgacaaaaattttagttaatttacttttttgctcttttaagatataatatattctatagtaagtataaaggatggagtataggatgaaaaattttgggaaattattattaacattattattatgctttagtgttgttggatgttctaatagcaaaagtacagaaaacattactaaagaattaaaagaagctggatatactattaaatataatagcgatgagtataccaccgttacagtaagtgaatcaagtggcggaaaagaaaaaagtcaatatattggatatgttgaagatgatgcaatttcatctattgcttatattgaactacctgaagattcagaaaattatgaagatatgataattggttttatctatgctagtgaagatagtgattctgaagtaacagacactgttaaagaagctgctgaaaaaaaattaaaaaagcttgatttaactattgatgatttagctaagtactttttagatatccataaagataaaggtgaatcgctaaattaaataaaaaccacgcctaaaagacgtggttttctctgaggctataagcctttgttacttgctcgcgtctcaaggcgctgctttcacttcgctcaagctattgcttttgactctcgctatccctcaaagggattattttcatttttttacttttttcttcttaacttcttgttttttcttttcttcctctatttccttatcctcgaatggattttggtattccttcacactcaatttgtccatcgcaatatcatgtcgttcctgttcccttatatactttgcgactgttgcatcattcaatcctactgtactcacataatatccttctgcccagaaatgtctattcccatatttatattttaaattcgcatgtctatcgaaaatcattaatgctgattttcctttcaaatatcccatgaactttgatacactttcctttggtggaatcattactaacatatgtacatgatcagacattaagtgcccttcgattatttccactcctttatatctgcatagcgtccttaaaatttcacctatatcttttcttagttgattataaatcacttttcgtctatacttgggtgtgaagacgatgtgatatttacacatccactttgtatgtgccaatgaatttgctttttgagccatacttctatcacctttcctttcatatatgatagcttgaacaactttaatatatatcggaaaggtgaatatttgtataacttttttatcgctccacccgcatagcaggtggttttttatttcgcatacttcgtatgctcaactgacttaagtctatatattcatacaagtatgaatattaaatcatataaaaaaagacctgctggtctttttttaattataattaatcttcaggataagtaataacaactcttgttaaaactcctttttgattctcggtaaccatttcatatttataaccttgatcatcactataatgtaaatgaccatcagtattttgagcaggatcccctagcattttaaatatatttttatgactagtagttttaccatccattgctaattcttcatcctcattggtaataaatacaatagaatctataccatgatgattttcttcttcagtaatagtatcataatctaaagttatttgtgtcaccttacaatcagcaactggtaagtcctcatcattatcgtttttataacgaatcccaaaccattgccaatcatcttcagaatcatctaaataaacttttaagaaagcaaccattgatgatacaccaccagcatttaaatcaggggcttcatcaactgttttacctgtatcacctaattctacttttgttcctattttttctaaatatctaacatattcaccaacagtctctggcaaacatacattttcttcctcaatagtaaaatacttgattaatccatttgattcagtaaacggtctttcttctttggtaaccttgttgtcagtagtatttgtttgattatcatcagtacctacatttgaatcatcctcactacaagatgtcaaaccaaacatcataattagtgctaaactcacacttaatactttctttagcatagattatctccttatttttttcatatacaaaagtattatagattctttttccgattttatctactatttttacaaaaaatattcaaaaatttattaattattactatcttctgcctttacataaaatctattaattagttttgatatagctttaggccaaaatctttggaacattactaagtcttcctttgttctaattctttcattaataatttccgttgtcgttgattcttcatgaacgcgatgtcccattaatggtttattaacaaaagtaaatttacccttttttaaagaaagtttttcccaggcagaccaatcaacattacaaacaaaatcacatttaaaaatatcttctgttttaatattatcttttataaaagtaactgctggacaactaatagcattaccgaagcgaagcgataatcgttttccaaacttagttgaagctaattttctgcttttaagaggtgataaaagtattcttttaattttcaaatttgtatttgtatatactttaccctctgttctaatttcataataatcactaaatacgattaaagaatcttgattcttttgataagctttaacaatttcatctgaatattcataatcataaatatcatcctggtgagcaactgttgttaattttgttttaccacaagaaattgcaaaatcaaaatcatagccaattccttgaccaggatttggatttactaatatctttaaagaatatttattagcaatgtttttaataaaatcattaggcgtagatgtagctataacaactttactagaatatttttgatttaatactgatttaatacaatcttctaaatattctgattctttatatgctaatacaacaaatgtatgcatgctttccctcctaaatattattaatgaaatttacgatttcatcaataattccctgtttttctgttttatactcttttggttcaaaagtatgagcttgattaactacttcgtcgagtttacttaaatcatcacaaggaataatataaccttgtttattaaaacgctccatgatctgtacctgatgatcattattttgttctttatatttacctaatctaggtacaacgaccgtccgttttttttgttttagtgatgaaacaattgctccaaccccagcatgagttataactaaatcggcaattttgatttgatgattcaattcctcttcactgtagtattcttgacaattaattccttgatatgtaccttttgtatatcctaattgcacatatacatcgttttctttaacaaattttgattccaaaattgcatttaataaacgatcaaagcgtttatcctgggttccaaacataacaaaaattctcattattttaaacctccccgatatttagcttttgggtataatttcaacatgtcttcccactgtactaaaaataaatctgctattggatatactaacttacctgataacgttttcgttgtaatattagcaaaagtttcaataaaaatcactttcttaccaaacatttttgcaatataacaaattggcactgttgtgtgggcaccagtagctattactaaatctggcttaacttttaaataagctttaaaactcttaaaaatattaattggaaaattacataaaaatttaaataaatgttctttagttccggcaggcatataccaggatctcgatttatttgtctttttataatcttgcatcatttcatgatcttctgtaattaaaaatgaattatagcgctccatcaattcttttaactcacatagctcactaaaatgacctcctgctgaagatgtaaaaataactcgtgtttttaaatcatggatattaaaatttttaaatgcctctacccattgagctctaacattttgatatgaaaactgctgagctttttttattgcattttcagatatttcttttggcaattgattcaatatagcgactatcttattagccatgtcatcaatatttctatctttgacaataaatccatctttttcattatcaattatatctagcgatcctttcgcactatcaaatgatacacatggtatcccataactcatagcctctaataataccaaaccaaaactttcataatgagacgtagtaacaaacacattagtatctttcaatactttctttttctcttctcctatggtattaccaaaaaaagtcactgctttacttattttcaattgatcagctaaagcaactaaattatctctttcttcaccatcacctaaaatattaagttttgcttcagggactttttttagtactttttcaaagacccttagcatatcatcgtatcctttttctttagaaagtctacccatcacagtaacttgttttgtatttaaagatgctttttcgtcggcaatttcatcaatacatggtgataagtatagacattgtggtccggttaagtattccttataaaattcatagattgattttgaaggtggtataaatagatcaaattttttaactgctttatatactttcttggcgtaattgggacttctatcgggatgacaatgttcccaagcaatcaacaatttatttttttgatattttgaaaaagctttattaaaagcaagcgttgttgaaacgataatatcaccatcattatctttagctgcctgttttattaaatttctttttttcaataccactttcaaagccttaaaaccttctgtaataatttttttaatactcttatttttaaatgcagattttaattcttctttattcggttttaaatcgttagaaagatatgtaacttttactctttcatcaatatagaaagaaggtttacacaattcatagacattaacgatttcgacatcatagtcatctacaagcatatttgcaagagagcaaatagctttttcaatcccacccacttttaaatgtaatgataaaattgttactttttgtttagcacgattgtgtttattaacaatttttttattagttcttaaataagcaaaattacaagcccagtttgcagttctttttaatcgttttaatttatgtttagaatgtttaaaacatacttgatgataatatatttgtgaatcttttaaaattctcattttacgataacgattaatatttttatcaatcgttactgcatgattatgaataatgttaacattatttaatacacatacttttaaccccgctttttttgctgtagcacataaaatatcttcttcataatatagaaatgttccttcatcaaaaaaaccaattttatcaattacctcttttttcattccaaaaaaacaacctgaaacacaatcaactggtgaacttacacctatataatgtcttttagaatatttgattacatttttaaataacctatttattacaggataattatcataaatatcataattaaccgttctttgtttccagccacgattaatttcaccgtgttcactgatcgttggtccaaaaatttgatactcatttaatgaattcatatatgctataaaatcaattaaattacgtttatcgacaataatatcaggattggcaattatatagttatcataattatgttcatataaatatcttaatccagcattgttaccagctgcataccctaaattattttctaaagcaattaatttaatattttctattttctctaattggcttaaagaatcatctgttgacccattatcaactactacaatttgattaactacatcataattattaatatcatttacaaacttaactgtttcctctgcatcattataatttaaaacaactataccagttttcactatcttcaccaccttaattttccatacgtacaattgtagtattataaaaatctgatgttttttgaacttccttgtttaatgcctcaaaacctatctcttccatcagggtctgtttgtcagaaaataagtttgttcctaatcctaagcgatcaccatcaatttttgctcccattgcagctaaaatcgttggatacatatccatggtactaaattttctatttttattattcttagcttctacgacactattaataatgcaattatacggtgttcttatataatttttatcaatatttgtaaaaaatttctcagacatactgttatgatctccagtaataacaatcgttgtattttcataccatgactgtgttttacaccagttaataaaatcatttacttgtttagattgacattcaataacatttgcatattgatcatcatacttattatcgcataaatcacataaatatccatctggcgtatgggtatcgatagttgtaatttctacgttaaatggcttatcaccactagccaattccgtaatatcttctttagcaaattcaaataatttggcatcttcaattccccaaaaaacaaaataatcatcaggtattttaccattttctttaaaataatcataatcaacaattttataatttccatgttgtttataaaaattagatgtaccaccaaaatcagcatcagaaccacaaataaattcattaacatacccattttcttcaaggacttcgccaattgcataaccccctgataaaaacttgctatcctgatcatattttttatccttaaaagatagcgttaaaggaactcccatattcatcgacacttgtgcggcaatcgtccattgggttccatcaactgttagactaccaccaatattatcattattagaaaaatttgtattttctttggcaagattactcaattcgggtatatagtttatttcttcggctccaccttgatcaagattagcataagtattttctactgattctaagtataaatgaataagatttcttttttctttagtaaaagtaatctctgtttcactcggatcaacataataagcttcatatatatcagttttttgaaaagcattaacaatataaccatatatatcataattatgaatcgtaaaaattaaagagctaattaaacagattattccccatttgataaaattttttcttataaaacgatatactttatgcccatatttttttattgcccgatgaaaattaaatataataatattttgtaatgtcacaatagcgatactaattggcacactaaaaataaaccagtctaaatatataccattatctgttccttccattggtacttttaaatgaaatataatttgattaagggtttttactgagaaagttctatttccccaaataattgaagtaacaatcaatgaacttataaatactaataaagaacctattattgtttttttatttattttttttaatttatttttcattgctattcctctttaaatttatttctttaatattctatcatattaacaacaattaataaataaaagaaaaaagtgaaactatgtttcactatagtactaatggaatcaaattaataactgttattgcggacattattggaatgattactaataaaaaacttattaatttttgatttaaatacaacttactattttgtagtggaatcaacaacagaaagatgattggaatataatatcgtccttgtactccctcaatcactgcatagccattaggtgtccatgctagagccattgccagcataaccactaagattacacctaatgaaattaaaaaatataatagcttatgctcatgagtaaaaacatcacgatctgacttttcaacaaaagcactaacaattaagataccaatccagctattgattacccatgtagggattggaatcatcaaccatcccattaatgaaccaactgctgtattaatataataacttcctttttgcacaaatgtatttaaaaataactgaattgtacctggtatattgcttaacattcctgataaggtatacgaaggtacccctgcccaaggaactacactttctcctgatactgtcccgatcgaacttgtttgatcattgcttaaaaaggagcgataatttaaaagaatgatacaaattattactattaaaaaaataataattttagtttttttagcatatggttccccattgggattaaaatatttagcaagtataggaattactaaaataaatgcatatgcagaacctttatttgcaagcaaaagtatccctgataaaccatatactatcacatcttttaattctacttcactagattgataaacaaaaaacattccataagcaatgcaaaaaaatgatgctgaattaatgattgtatcataagataatgaaaacatctgatggcttgccattggcagcatcgtaattgcaaataatagtacttttccaaaaggaatttttttaagagctaaataagtaagagctaaataaaaaataaaattgcataatctagctacatatacagtagtaacagctcctaaatgaagtactcttgatactgttgttcctaaaacagctggaaaatagccaaataattgtcctaatcctggggattcaacatctatatttgaataattattatctttgctaatactaaaaatattattatatatataattataataatcattattaccaactgttatttgctgattatataattcaagttcactatttttcatagttattttattattttcttcttttccaattatttgacttgataaagaaaacgtgttttgcatatgcacccattcatcaggtacaattcctggaggaattaataaagtataaatcaagcctaaaggaattgcacaagttataaatactttttctaatttatatttaccttctagtattttattaatacctaaaaaaagaaatacacaaatatatatcgaaacgattgtatagataattgtaaaactaaatggtttatctattgggcggtatttactaaacagatataccatcattataattacaatcataatagctataactttatgataatttttatgctcattttctttatcttcaaccacataatcttcacttaagttatcgtctaactcattttcttcaaaatatatattattttctgtttttgcgtgtctcattaaaccaactcctaaaaatgctagtattttttataatactagcatttctactattaataatcaatttcttttaaatatctatttaaagcatcttgccaggtaggtaaacgatcaaatccgtttttatctagcatatctttagacattctactattgtttggtctttttgctttagcaggaaacgcatcagaatcaacaggagttacctcaacactcatccccgcttgtttaaaaatttcacatgcaaattcataccatgaacataatccttcatttgttgcatgatagattccgtatttatctgtttgaatcatatcaacaactaattttgataaatcatatgtataagttggtgatcctatttggtcatttacaacactaacagcaccacgttctttacctaaacgaagcattgttttaataaaattattaccattaaccccaaacacccaagcaattctgacaatgaaaaatttatctaatgcttctactgctaattctccttcatatttagtttgaccataaacatttaatggatgtcttttatcatactcgttccatggtgtttcaccttgaccatcaaatacataatcagttgaaaaatacatcattggaatatctaattctttacatacattagcaatatttttagttccttctacgtttacttttgtacaagcttctacttcatcttcagctttatctacagctgtccatgctgcacagtgtacaactgcgtcataatttccttcttttattacttcttcaacttttttagcgtcagtaatatccatttcttcaacatctacacctactgcttcaatatttctttttttacattcattgacaatatcatgtcctaattgtcccttaacaccagttactaataatttcatttgatttctccttacaataataatttttaaattttaaaatctatctatgtttactattaatatttctaccatattaatggcttaatgcttttttgataataacacattcctagttttcgtctaataataatataataataatacatcaaatgacctcgataaaaatactttaaatcacgttttaatattttaaaacgtatttttgcttttttactagaatcacttactaatgaaaaatcttgaattaaaatattatctttcataattacaaatttcttatttctatttttcatcgttctcataaaatcatgatcaacaaaatctaaaaacatattttcatcatattgataatccctaaaaatttcacttttaattatcattccactattaatagccgacatattttcattattaagcatatcaatattttttgcacgatgacaatataaattcttcataattgacggtgacaacaaccccaattgatcttccaccacaggtaaatatatatcaccaggtttattattaatatattttaatgctttttcaaaatattgcttcctaacagttgtatcatcatcaaatatacatattaattttgagtttttaccaatctgttgtaatccttggttataggctttaggtaaccctttattcccacccatacttatatactgataattataatcttttacaatatcttcattattaaaattttttgtactattatcaacaacaattacattaatatcttttatctttcttaaatcttgaatagtttttgaatcatgataattcttattatatattaccaaaattacataaaaatcttctattttatagctcatatattatactccctaactatattgtacaataaattcttaaaaataaattaatcactttaaaatcaatcatccttacaaaaagccatacgatcaactgataattaatactttctccttttattttaataattcctaaatatttgttcttattaaaatttggaaatctttcttttaaccaaattatattttcattcaatgtatttcttaccaattcataaggagtatgtcttgtagcatataacatataccatacatttaacttaataaaataatattctattaaatcatcaataacaatattgttatctattagtttacaatatattgaatttaataaataatcaaactgtaaaccatttgataaacttttatgtgctgtattagacacacttgcttcattataaaaccagttatatcctacataattaataatttttatttttttagtaagggtaaccgcctgaatcgtaaaatttatatcttctccaatattagagtctaaaaattttatcgcattatctttgatatatgatgttctataaatttttgcccaagcagcaacaattttaaactttgaatattcgcaatcttctaatataacctgatcgacgatcttgttattactattaggtcttttatatcctccaattacaacatctaaatcacctttttcaatctcagaaacaaaagtacctatgtagttactatcaaaataatcatcattatcaacaaataacaagtattttcctgttgctaaatcgatccctttatttctggttttagaaactcccatattttcttgcttaatggttttcattttatcagaaaatttattttgataatctgttaatatttcccatgaattatctcttgatccatcatcgattgctatcaattcaaaattattataattttgctcaaaaatactatctaaacatcttttaagatattcttgtgcgttataaactggtaaaactattgatacttttttttccattataacctgccattcctttccgactgtattcaaaagatatattaaaatcaataaatcacaagactatttaaatactataaatttattcttttattaattttttatattcatatttaaaataaatagtatataacaatccatgccacatcatcgttccaaaatatgcatatgtcgcaccatgaataccaaattttgttataaataaatttgatagtatccatcctataatagcactactaatataaattacaagttgtaaattattttttctcattgtaattaaaccggtagaaaatacattagctaaagcatataaaattgcccccataatgattattaataaatcgtatttataagcagataaatctattgcatatactaaacttaatactggtattcccaataaataagcagccacctctattacaattccaaataatatgataagtttaacaattttatatactaaagatttaaattttgaataatctttaccattatatgcctctactaattccgtcaatattggtcccataatatattgaccacataaacttattactgtagcaggcatgacaattatattaaatattgtctgaaaggaatcatccattattccatcaattgtatacttaggtacattaacgatataaattgctaaaaaagaaaatgcaaatacagtaaaaccagctttaaataaattaataactcttttagatttcacttcttgacgctgagttatcttttttactactggaaaatcaaataaaataatcactaataaattaactataattaatccataacaagaaaatattaaattttttgttgttaaatctatcaaaagaaagagaatgattgatattattgacttaaaaaactgtgacatgccacatagatataaattattatttttttgcatatagccatataacgtatcactaaaagcctctaaacatttgtacaaagttaacgtaattataactatattcttttctatagaataattctttataaaaatatacccaaagcagatcagcatcattatagcgcatgttataattttatgtactaaatactctgtatcattcaattcacccttcacatcagaaacttgatatgttctaccagcataaattccgactacaaataataaacaagctaatgaaaaggcaaaactaaatattccaccatcatctattccattaattcgattaattataattaaaaagaaaagtgaattaaacgaattaaatgttaatcctaatgtgttccaaattacatttttttttaaattatttttcattatcatttacctttttctttaacatagatatttcttgtattaataaattaatttttgtcgtttgtcctgctattataacagtaagtgcaattataattaaaaatagtaccacaaataaaaaaccggcaacaagattagatattgtttggaagcctaaaattcctgctacaaattcaaataaagaaggaaataaggctaataaaacaattgcaaatgaaggaacataccaaactaaagcaaatttcattggaattcttccttttttcaaaattatcgttactataactattaaaaaaataccaactcctaataagcctcttactagattatctgacatgtttaaacctccttatcccaactactaaaatagacaaaatcacattgatcataaaatatacagttttccaagagttaatcgaagaaaccccaccctctcgttcattcattgaaactgctacttctttaataatataattcttttttaaaagttcagtattagtaatcggctctgggtaatcgattggatatgatttagcaaaatcttcaataaccaaacggccagaggctctaaatcccgaagtaacatcatatactttttttcctgtaactagtttaataaaaaaggaaataattttaataccaatttgcctagcagtagaagatttaaattcactagttgattcatcaataaatctcgaacctatagttaaatcagcttctccttgtaaaattggtctaataatattatcaacataactaacatcatgctgtccatcaccatcatattgaattgccacatcataatcattctctagagcatacttataacctgtttgaactgcgcctccaatacctagattatgaactaaaggaattacgggaatattgttttctatacatattttcaaagtgttatctgttgaacaatcatttataacgatcacatcatagctagtattgttatccttattatatttaattattttattatacgcttttaaaatattcgcttcttcattatacgccggtattataatcaatacttttttttccataatttctccattctttcttacctattagctttgcttatttataatattatttaaattttctatcttcgaagattataacatatagaattgcataaataaagtttcataaattatactgattaaaaatattcaatatcttatttaacataattttatgatgaaatattaagaataaaatttttaatatatattaaattgatactttttagtattaacaatattatttatatatctgtatcataaaaatgtgcaatttaaaaatcaaaaaataatttatcaaaatttctgatttttattaaaattaattttatataaaccactttacttattacaatcaaaaaatttaatattctttcataattaaacccaaaaggttaaatcaagatttctcttaaaataaatttatttaatatatcattttcttttttataacatatatttatcttatcaaagaagcgccataaagtatagcgcttcaaatcacgattaaatttttaaatattatttttattttagacaataattaatgcccctaaaatattaataactgtaattgtttgaaggataattataaacattataaaatatctgttcaaattatttttgataataattttcttgtttctaataaatattactaaaaacactatcactggtaaaaaatatcttccttgtactccttcaattgttggccaaccaacaggagtaaacgcaaacgccattgctaacattgaagctccacatactgcaaaaaaagttaataaatatattatcttatgcaatattgatatatcagctgtatcgttcttatttttaaatccagaagtaaataatgcaactaaccagattataaatatatttctagatagtattaaatttaatgacccaagatattgtcctaaagttgtaaaaacataatgatcaaattttttcactacagttcttacaaaaagcataactgtttctttaatgtgtgatataaaatatgtaaaactatagccttcttgattcgcccatgtaacaacatttgcttttgataccgatctagcagcaagattattatttgttaataaaggtaatcctaccattgttataatccatggacagattaatgttattttagttaatattctttctttggtatcagaaattcttgttttatttattaatattggaattaaattcaataaaaagtaaataccacttttttgtgtcactaatacacatgaggcaataatgtaaattaacatatcaactttttttattttattttttccataaacaaaataaaagccatatcctattactaaccaagcacttgataaaataatcgtatcataagataacgatgaacattgatgaataaccattggtaaaagcccgatcgtaaaaattgtggttttaaatattggtatttttttaatagcataatacgaagctacagcatatataataagatttccaaatcttgcgatatatattgtaagtataccatctattgataaaattctacataatgttactaataaaattcctggcaaatacgatataacattaaaatccaccgacagattaattcctgtatttacatagttattatcattatcgtataaattaatcatctttctataactatttaaagttttaatcgatggttgtgtatctccaataaaattttcactctccctaataacaatatcttctcttgaacctttggacattaataccgaagaaaaacctaatgtatttcttatatgtgttgtatcatcaggtatattccctggtgtaaacaaaatcatataacatattccgcataataaaactgtaacaataaaaattttttctaatgattctttttttataaaaataaaataaaaacttattattaatattaaatccactaaaataaaaataattattgatagcggagtaacaaaatcaggcattgtactatatattttatatgccaagtgtgcctctacatctgtatcttcactatcacaaactctagtctgaacaccttcactattattaatttcttctaattttataactatatcttcgctactttttttattagtaatttcaacttttatttcctgggatgcagtgtttggtaatactatttcttctaatgaatttaaaatttcaccatctatattttcaactatagcccttattttaccttctgtttgtgagttaaggttttgaactgtcaaaactaccgatgacaattttgaatcactacttttaaaactatatttattatcaattatttgtccttcttgcaaaggaacccatctatcttttaatatattatttttatcaaacaacacatctctgttcattttaggatttatatatacaaatcctattacaattgaaagtacaattataatagttgacaccaacaaaaaaacattttttttattacaacataccttccctttcaatttatccatcatttctactcctcagatttgctatacattatttattggtaattattttaaacatcattatagtaatactttttcatttcatcatctactattttatgctattaatacaaagctaatattatttagaatctttcttataaatcttatttttttctaatctatctattctcccaacaagtcctgccttataatctctataccccttatacatatatgacaattttcgaaatttatctttttcaaaaaataatacttttaatgcttcttttctagtacattttttttcaagttcacaatattcgggaaaatcattcacatatttatcataaaaatagtgacgattgcgaacgatataatatcttcttatataattatggttatcaagataaaatattttctttcctatatttctttttacagtatcaccaagttcgtgctgtaatacagctttatttacctgaacgatctcataccctttctttcttaatgctaaacaaaaataaaaatcaacacaatcaataaaataccattctggataaccctcaacttcctgataagcttttaaattaactaaatttccagatgtcataactaaaattggatgatctatcccttctaaatgaataccctcagttcttttagttagatggaacggtgaaacgatacctatttttttatcatttccttcaactgattttatatattctttcatttcatgtaatgaattttttttaaaataactatcttgatccatcgttaaaagccaagaacagccatcttctattgctctttttgcaccaatatttaaagctgctgaaattcctaaattatccatattgggaatatattcaattttttctattccttcaaacatttttgaattatcttcattagaattatctacaacatataatttttttaattctggtaaataagttctaatattaaataatatttcttctttattgggattatatgcaactactactcctgaatacatttaacatacctctatttaataagctttcttgaaatttttttcaatgcctctggcaattgaattctagatactaatttccatcttcttgaatttaatatttcatctaactgtgggttataactagcttgtttttcactcttgcaaaataaaattaaatcacgtaacgcttgactattgaatgactcatttgatttatatgtataatgtttcatatactctttattcatttcaacaacttcttttacttgatatttatttaaattattaattttagtctgatactcttctttattatttttaatatgaataacctgttctaaaatctgctcattagaagcactcatgtttattgtccagccaaaaccatatttgtttattctctctcctacagcaccaatatctaatgcaaaaactggaacaccaccagaaattgtttctgttaaagtatatgaatatgtttctggccaaatcgacaaattacataccatgtgaatattattcttctttagtagtttttgtaattctgtcctattatagcgaccatgataagtataattatcagtatttctttctaaagaatcaaactctgaagttccaaataaatgatacttaatagttttatcttttgtattttttactaaatattcaattactttagcacctttatgcttagccataactccaacaaaagcaatattaaattcattttcctcgatctttaaattacttttttgtttatctgcacgaattccatgttctattactgtacaatctaaatcattatatacattctctactatcatctttgtagactctgaaggtgtaataatcaaattaaatccttttaaaaattcataccatcttttttgccaaattggtattatatcatttgccaagcgcattttattatacaaacactctttacaattcttctccttttgatcaagtgataaacaatatttttccatattatataacatgttaattgaaggacataagcaataaaaatcatgtaatgtaataatcgtctttatattgttttctttagctacatctaaaatatcaaaatagtgccctatcatatgatgtatatgtaaaacatcaatttgtaacccttttattattttttctgctaatttataataatctttattaaaatagctatactggctatacgcacttacaccatcaaaaacaagttcctgttcatcatcttcaaaaaatgaatgaactttataaattccattactaggaaaaagaacatgaaagttatactttgatcttaattctgtaataatatccatacaatgaatagtcgttccaccaagattatttctcggattttcaaaatcatgaattaaaaataaaatattttgtcgttgtcgcaattgaatgttatataaaatattagtacatatattatttagcggaaactgacggcaccataaatctattttttgagaatatgctggataacgatcatgcaaaacttccaaattatgctttaataactgtgttttatcatctaaaaaagattgactctctttatgcaaaacaataacctcatcacatgcaacatttcgatacccataatcaagacatctaaatgaaaaatcattttcttctccatacccgcgaccaaatttttcttcatcaaaatatccaactaaatttaaaacctctcttttaataaacatacaaaaaccatgtgttgttggtaaatcaggatattctaaatatgatgcttcagctacgatatttgcatattcttcaaatgtataatttttaggaatatcatttggctgtaagcctactggtacagatactagcgtagcattattcgataatgctgttactgttgcaattgttttatctgaatatgcgcatttctgaatacgctccaaccataaactaggtacttctgtatcgctatttaatagtaatacatcattttgagaatacttcattcctctattaacagtaccaacaaatcctaaattcttttcattatacaacacatctatattaatatcattatacttattttctatttctcttaaatattctcttactctttcatcaggacttttatcatcgataagaataagtccattattatttaaatcagtatttctaataatactatcgatacattcctttaaacagtctaatgcattatatattggaataattatgtcacaacgcttcatttatattctccttatttttatacttgttctgcgaaacctcgttctaattttttaaagattttatacccaatcacacatactagtatagatataatgattaatactaaaattgattttacccctggtaatatatgatacataaatgtatttctatacgctgttagaatatgcgttagaggatttaggtttaataaaaatgcaaattttgctggtaattgactagatgtataaagaataggtgtagcataaaaaatcatatttaaaataaaagtaacaatatattctgtatcttgaatatagatattaattgcactcaatacaaaaaccaatcctaatgtaaataaaaattgaattactgctatcagtggaactagtactatatgccaagaaattcctacaccactaaaaatacagaatacaattattatcaaacatgaaataaaaaaattcacaagaccactcaatacaacagaaataggcaatatttctctaggaaaataaactttttttataatccctgcattagcttttattgttgtcattccttgtaccatcgttgttaaaaagaaattccaaggtataatacctgtaacaacaaaaatcaaataattatccatatcatttttcataattattgaaaaaacgatcgtatatacaattgtttgtaataaaggatttataaatgaccatagcacccctaaaaaagatcctttatattttccacgtatttctttttttacatttgatttcaataattcgcgataattatataaatctttaaataatttcatatcatactctcctattatcccttagaaaattttatttctttttcaagaacatcaattccatccgaatctgttaaaatcacttttattacatgttctccaatagaaatactattacaatcaatatctatagcccatcctattttatctttatttaaatctataaattcacttttgtaagcctcatacacatcatttcttggttttctaaaaatacctttttgctcaactttatcaataaacaattttaattttgtattaggatgctcacttatttcccatccctctactctgatttgattagtagtagaatctattttttcaaatgattttggtttttcaataaacataacagctttagtttgaatatctaaatcggctttattaatttcaccctttttataagcctctctttgttgttttaaatactcgttgattacataggtaggatcaccatctaacctaaattctcctttatataaccaaattgctcttgtacataattctttaacagtatctaagctatgtgaaacaataacaattgttttttctgtatcacgaagttcttttaatttctcaaaacatttttcttgaaaatgttgatctccaaccgcaagtatttcatcaattagtaaaatttctgcatcaacattaattgcaattgaaaaagctaacctcatatacattccagatgaatatgttctaactggattatctataaaatctgctaattctgaaaattcaataatatcatctatccttctttctatctcttttctactcaaaccaaaaatagatgcattaaaatatatattttctcgtcctgtaaaatcaggatgaaatcctgctcccaattcaagcaatgaggttaatttcccatttgtttttagagttccttgctcaggataaagaatttgtgtcattaattttaataatgttgacttcccacttccattagtaccaattaacgcaacagtttctcctttttttatatctatatttatattttttaatacttgatggtattcaatttctttttttctaaatatattgattaaattttcttttaaagtaaatggtttatcatactgaactttaaaacgtttatataaatttcttacttcaatagcattatctttattttccattttaacacctctcaagtactatatcataaatatattatttttgatataattatcttcttaatatcaacactatttttttatcgcaagttgtaaaatgaaactggaattaagacaaagtaaagcttgctagtcaatatttacttttgtttttatcccttatcttcttttaaatttttacatgaaaaacgttcatagaaatcgtattatatcgttactacactttataaaggagatctctatgaacatctatattatatcacaaaaatatgaaaataaacatcttcaattttttcactataaatttattatcaatagtcttaatcagtcaatgccaaatataaagatcttaaggataacactggcaaactcaattcattagacatttggctaattctgttggtacttctatctctaatgtctattcgatatgctactatactgttagaaatactcatattaatgagtatactttaggctacctttgaaaaaagatctaaaaatcataaaattcctaacattctgaacttgttaaagatggtataaaatcaaacagactttcttctgtcgatgaaaccattaattactttatcttcatgaaaagggactgaattaagaacatggaaattgtttctactcagattttctataattacatatacgaaggaagagtatcgataaagcctatcaatctgcctaaaatgctgagaagaaaaactaaaaagaactagaaaacctatattcccaaaagacagaggaaaacttccgttactaaaagaccttaaagtattgatacaaaatatgctagaatgacacttattcgaccctgattgaaagaaaaataagattttattatagttccaaatcttctaaaaaagtttatatgcaaatctacaaaatttataagttctatggcaatggtttttagaaaatattcagattcatttcatttgataatgaaagtgatttgtcagatggagggatgtggagaaaaagcttgaatcaaagaaaaaccatacaaaagtttatttttgaagacattattattcatgtgatagaacatcaaataaaaaccataatgattttataagatattatttcaattgatatcaatacaatagcaaataaaaggaagatacttgaaatatcttcctgctgaacagccattcttaaaaaaattagctgaaatttgtataactaaaaatactattttctatagagattagagttttatatcttatttccacttctacttgcaattcagaataattttttgaattgttttttccatgccttaatattttcttccggtaaagaaatacttgtctcatgttcactatttatccattgttctaagatattttcaatatcatttctttcaattactggtaaatttgtatctttagatatcgctcttgcacgattatctatagaaataatcaaactcctatttaaataatttaaacttctaattccagcatgcaatcttgtcccaatgtattccacattgtctttttttagtactttatccaactcaactaaagatggtggaattattttaaactcccttaaatcaacaattgattccaaatattcgtaatcatattgtccttgtatccatatatatacttcagcataattattttttaatatttcaagcattttaacatctttatcaggatctttcatgtaatcagtcactgtggtaactactatgtctgatttttttgatgatattttcttacaatgttcaggagtcaatgcccacattgttggacaactagtatttataacgttctttataccaatattctctaacgctttttttgtttcatcatcacgcacagaatgaataattttaggatttaacatatattttaataattttttactatattcactcatatcatgttctaaatctatactttgcataccaacacccaacaaacatatattattcattactttaatatcacttggaaaagcaaactgtctcgaatcttccattcttttatatattaaatttgttccgcataatatttttaaatcatcttctatatgttctgattttttatcataaatatgagttggtatacgtaagaaatttgatttttttaaaacatcttcacagatattttgacaatacgacattattatttcatcaccaacattatcagacccaatacctgtatctaataaaaccacctctttatttaatgataaacgtttccactttttctttttaattgcgttatctaattcaatgcatttttcattataactcttatttggtaactgtaactcgtaataatgttttgtttcgcattttttccatctataaaaatcataatcaggttttattagtccagggtgtgttgttaattcaactaaaaaatctatatacttattaaattctaaatattttaaaaattcattccttctttcttcatcattaatacataatttattttcaataatattttttgatatttcagccatctcaaaaacattaaaattttctattaaatatcctcgattatctgcaagcattgtgttaattccacctgcatttttaaaaccaacaacaggaatattataatttaatgcttctaatacaaccgatggaaaaggatcttctctagatgtagaccaaaaaatatttatatttgataaaagactcttatatttatcttgattctctataaatgggataatatgcatacattctgttaatccagctctttctatctgattgtacatccacccttcaagttcccagttattaccaaaatttcctgtccaaacaaaatgaatttcttttgaacatattttttttaaaatagatgctgctgaaataaataaatcaattccctttcttaactcacatgttcctgaattcataataatataatcatttatagtaaatccatacttactaaaatcattttcttgcgtttttatatcactttccagatatacgccttgtggtctaatcaaacattttccaacaatttcaggaaataattttttaaaatcatcagcaactatttcgtcaggaaatacaatataatctgaatatcttgatacttcttttccataattataaaaattatataattctattgtagttttcatttcatgaattaaagatataattttaaaatcataatcttttaatactcttacatattccccaccaacaacagtattagtaatgacttttgaataaccatcatttcttaacatctctaatattgcttgtacatattcgattcctgtcagatactttattccattataatttaaacattcatatatattagaataattataattattattatctaagtaaattataggtattttagcttccgcatatttttttgttaaaaaactaacattatgatgccctgctaaaacaacaacctctttacctatattcttcatttttttagcaatattatatgctaatataggtgcccctgtaccggttaagttgtgagtcaatatcactatcttatcatctgtagtattttcatttatatttttctttaaacatgttagtatagtatcttgattagttaaaggttcaatatttattgtatcaattttcatctttgcatttaggtcgtgtatgtcaagtcttatttcattaatttcattaaaaaaatggatttcatgaatactatctgccttagtatttaacttaaaatgcactttattttcttctttgaatatttcattaaaatttctataatatactattgcatcaaaaaaatcttcaactgcatccatacctctaaagtttaatctaattcctttaatagattcatttaatcttatgtatatttgaggatcattattagtaaattcccaaaaatcaccattttctataatattttcactactaataaattcgccatttttcactaaaacctttgtttctatcatatcttaattatttctccttttacaacgatccttttccatatactacacttttaacagttttatacataattgtaaaatctaaccaaatagaccaattatgataataataatcgtctaatttacatctataactaaattccacatcacttctaccattggcctgccacattcccgtaatacctggtttaagttgaataattgaatcatagtattgccccatatcatctttttcacgaggaagatatggtctaggtcctatgaaactcatttcaccttttaatacatttatgaattgaggccattcatctaaagatgtttttcttaaaaaatgccctacttcagtaattctaggatcgttttttaatttcttattagtcaaatattcttctttgatctttggatcttctgccatcattttttccaacgcatcttcagcatttggaaccattgatctaaatttatatatttttattaatttaccatttttaccaattctctcttgtgaaaatattatattatcattatctccactttttatgtatttatatttaacaaacatcaccagtggtaccaacgtagtaacaccaactattcctactataatatcaataaagcgtttaaacattcgatccaataaagacattttatcatttgatgtggcaattaataattgcccatcaaaatcttgtacttctgatgaaaaagtcattgttccgtttacatttggcaagtatttaacagcttctactttaccgtagatatcactcatcactttatccaatacttgttgatttgcttctggtaaagcaataattatctgctctatttttaaattattaatagcttcatctattttactatagtcataaacatggctatgcttaataatattatcttgtttaaagccatataattcattagttttatttacatctacatatcctttaacatctgttaaagcaaaacgattattattagaaattttacccaatctagctgcttcgtatcctgtgccaataactaatgttctccgtgcaaattgttctctaaatgctattcttaaaaatctcgaagctaataaactaatcaagaacattgaaacaaccattaaagttaaatgaattcttctttcgtatcctgttgatttaggtacaagtactaatagtgcaataaaaaaacaaaaacttgattttactaactgtttgatctcattccatatcaaacaagtatttaaagaatagtgcccataaataaataagaataaaaaatatagtgttcctgaacctaaaatcaaatcgttgtccatattaaaatataaacagataaaataatacatcactatttctattgcaaataacataaatggcattatttttctattcataatctcacctcgacattcatagaacaattataccctattatcttaattatttctatcttttatcgcttggttacatctatttgacattaaaccataaatataaatctaaattccaactcaattttataaataacagaatgtagttttcaaattagaaatacttttttattacccaaggcataaaagataaatttttatctatcaattttattctttatataaataaagaacaagtaaaatattaataacacctttacttgttcaatatttttattgctattaaacttggtttaaaatgcaattgtctaattcatcataaacaattataattttagatatttggatctgtaggatcccaagtctgattaagtggtaatttttgagcacttggtttactcaatggatcatttccacctataacaatatcaactcttgtaccaagagcacagttatcataaatccatttagcatctccacatgttaatcttacacaaccatgtgaacacgttgttccaagttgattatacattctaggtgacaaagtatatatgttcatcttattatatggtactgaatgaaacaatataccgcctacaatccttgttgaatattgtccataacttggtcccatcaactctctccaacgatattttgccggcgtataaaatgttcctataggagtatcattaccaacagaacacacaaatcttttaaatgctatagtatattcaccagtaccatcttgagttaatactgtcacaacattacttcctttattaactcttaacacataggaagaacgcacacccaataaaccttctgcatcttcatataatcttccatttgcatcataacatattttatatccgtttttttctataaatgaaacagatcttctcatcccattatttaaaatactgacacccttaggacataatttaacttcgattgcttctatcctaaaacttccaccaacagtaccagcaacttgatcatttttagcccagtctaaccaacccaactcttggacatgaactcgataatatatatcataatagttagaaatttctcctgttaatttgatttttattgcttctactctttttgaacttcctgcaattccacaaatttctccatcagaaacatagtctaaccagccataatcctgaatatgaccactatattcaatattaccactataataattttctcctagactgatttttaaagcttctattcttcttttttgattaattgtaccactcgtatttccatttgtttttaaatccatccaaccatatccctgcacataagaaacataattgacatttcccattccaacaaatggacgattagtattgcctggagcaggattatttttttctatcagctttatttctattgcctctattctatagctaaatgtttcagttcctgctttttcatcatttttagcccaatctaaccaacctaattcttgaacatgaacgcgataatatacgtcataataattagacacttcaccaactagtcttattttaatggcttctaatcttaacttttggccaactgtaccacttaaagtttcattacttctataatcttgccacccaatattttggatgtgactactatactcaacgtttccctcatatggtaaatcagatatatttattcttataccctctactctttttgattttccaacagttcctgaagtggctccatcaccaacatttttcaaccaacctaaatcctctacatgtgttgagtaataaatattacctggtgatctaaacgagatatttgttgattccggtggtgtatcgccctttttaataagttgtatttcaattgcttccatacgataagcatatgcttggctgccagctgctttaccattacatgcccaatctaaccagccataattttgaatatgaactcgataataaatatcataataattacttatttcaccagtcagtttaattttaattgcttcaagtcgaagactttttcctattgttccactagttacatcattacttacataattactccaaccaatgttttgaatatgtgttgaataactaattccacctgataaactacctgaatctaattttattttaatagcctctaatcttttagactttccacttgttcctgctgcctttccggcttcaacatatgattgccaacctatatcctgtacatgtgctgaatatgtgatctttggtagtacgatatcctgctcattcattttttcaacattttcattcgtatcttgtgactctgtattattatcttgtcccattttcgactcagtttcctgctcttctgttacaacactgtcattatcttttgaatctgattcaagagcataaatattactaactatggtagtaaaaattaatacaagtgttataactatactcaataactttttcatttttcacctcctattatcattttatcatatactatatatgaaaaatatttaatattgtatttttataaattaaataatgcaaaaaactaatcttctatccttttacatcaccatgtatttacaataataactcagataattaatttatcctctactagttattctttatactaattcttttagttactataaattaacaataattttcccttgtttatagtattttcaatttttagaaaaccttgctaaattttaatatactttgtttatctatctgtaaactttttcaatatcttaatattttaatttacttactttaatttgtatactttaatcatattaacttttatgtttaatatatttatgtatttatcaaaaatatttatttttctcactttccaattattcgattcttcgttataatcactatacctactttaaattttattaatttattactgcatgaaacttacagttattattaaccattaacaattacgtttcaccatagatatataatacataaaaaagatgacaagtgtactccttgtcatcttacttttattttattataaaactattttctgtacttcctggagctttgccacctttttccaccaatacaatttgaattgcttctaatctttttgatagaccttctgttcctgcactagcaccattttttgcccaacctagccagtcatagtcctgaacatgtactcgataataaatatcatatttattggccatttctcctgtcaatcttatctggattgcttctaatctctttgattgtcctattgttcctgagattgctccattactttgccagccctgccagccaagatcttgtacatgacttcgatattgaatcgatcctgaataattaggattttctaatgctattgttattccttctattctttttgactgcccgcttgttcctgatacttctccatcatattttgcttcttgccagccgatatcctgtacatgtgtactataacttacatagtgctgtacaaatggtcttgttgttgctcctggtgcttttccgcctttttctaccagtacaatctggattgcttctagacgataactatatcctgctgttcctgctgattcaccatttttggcccaatctaaccagccaaattcctgggcatgtactcgataatatatatcatagtaattagccatttgaccggttaactttatctcaatagcttccattctttttgattgtccacttgttcctgagattgctccattactttgccagctctgccagccgatatcttgaatatgacttcgatattgaataccttcaatattattagtaatatttattctaattgcttctaatctctttgactgcattgttgttcctgaagtcgtaccattacttcgcagatcctgccagccaatatcttcaatatgagtttgatatgttacagatggtttagaaaccgttactctacagcttgctgtttttccattgcttgttcttacagtaattgttgccgttccagcactttttgctgtaactcttcctgcacttactgttgccacactgctgttactcgttgtccatgttagtgttttatttgtaacattttcaggagtaatagtggctataagattttcactactactaacataaagatttaaactcgttttattaagtgatacgcttactggttcattgctttgaacaagtctaaacataactgcttctatttgttcattacctgaagtatcaccactattttctccttgattagtccattctgtccaaccaagattagataaataagtacgatattgtaaaatatatcctaaattattatctgttaaaacgacattaattgcttgtaatggtaatgattctccttctgttccattgattgtttcatcattaacatcatttctcgtcacccagccatttacattgtcataagtttttatagttaattgataatcacctaaattatcaattccgattttaaacgcttctaatgatagcgattctccaatcgttcctgcaatctgactatctccaacataatccagccagcctttttcactaacatgtgcttgataataaattgatggactataaacaatagaactatcttttactagtctaaagtcaattgcttgaatattctttccaactgttccagcattatttccttgatcagtccatgcctgccagccaatatccgcactatgaactcgatattgtaatttataacctgcttgattattcaaattaaaattaactaattgtaatgctgaatttgcatttccaataacagtagaagaagtgatcttatcataattcagccatgaaccattgctatatacttgccctgataatactgctgacttaactgcattctttaaattcatcttgatttgatataagtctaatgaacgtcctgtagtccctgctgtattaggttcatttacctcatctaaccagccaatattttgactattggctgaataatataaagttggttcattatcgcctttacctgttggttgtcctgtggtattttcagtatttgttacattgcttgatgaatcactacctgtacatactattgttacacttgattttggaatatatccataatctttatcaaaatcatattctgattgacttggattttgaattattcctgtacgatcactattaactgctccatcagattgaattttgtaatagttatttttatctccattttttaaaacaataaatggataatttgaaggagcatagctactatacgtacttttagaactcacaggatatgtagagtataatgtttttgaaccactgcttgcatcactttttatgttaataatagaatgattattatttaatgtatcttttattgcaatcgtatattttgatgcatcttttgatcctaaatactcatcaattcgccaacaaatagcagctcctttttctccccaatatggatctgaagcatatttaacatttaaaccacttgctttatcacctaaattagctccataataacggctatcagttacaggatctaaataacctttagatataaacattgcggaatgataatatacactatattcaacagaagaatagccatttgcacttccgtttgggtcgctgtcatatgcagcgtgaccaaataaattattcttttgatctgcaatattactacaaccccatgcactttcatttgcggctactgccaacattaataatgcatttgttccatattcattttgattcgaaataaaacattctcctaaatttcttaatttcgaagttcttccatatgaattttcagatgcaccaactaatgctgatatagccttattcaattcatctgcactatatgtagttatactacggtgggataaatattgataataattataatatggtgaagaactattaaccgcatttgttcttctgttatttcgataatcatctaacattttagcatagcttgctgctgtactgccttcataaaaataatgaccatcataactataataatcatagccctcttttaaatatgatggtgcagttcctgcatccaatgacgagctatagccactatttgataaatttgtagaaattccgtgatataatttaccattttttacataatacttacttaatgtattaactttagaatcagtataatttaatacctctactttattaacatcaacccagccaattacacctgcctgcataaatttaacttttgtaggatttgtttcattatcatatcccaaaaaggctccatcagcagcataatagccatttgtatagccttctctgtttgttccatcttcataatatgaagtattagtactagcagagctataaattctaaaattaactacagctgtagatgagttagtaattctttcaatactacgactttgaacttttttagagttattactcttaggcatattttcttcaacatcatctagcaaatatacattaccattctcatccattgtagttacaacttcatcatctcttaatgtatcaccagcaacaaattcttcatcttttgtgctttcttcagctgatacattatttaatggcatcctaatagaaaaactcatagttaaaacaactaatgagataaataatctttttaattttctgttcatcatcaacctcctcttattatcccagtaaaattatagcatattgactcaaaattactagttaaactatatgattaacatagtatgggaaaaaatttaaaataaggaagtctaaatgactcccttaaaaatactatttttccactaattttatctcaattgcctctaaacgttttgacaatcctattgttcctgcactagcaccgtttttagcccagcctagccatccatagtcttctacatgtgctcgataataaatatcatatttattggccatttctccagtcaatcttatttgtattgcttccaatctctttgattgtcctactgttcctgagattgctccattactttgccagctctgccagccgatatcttgtacatgacttcgatattgaatcgatcctgaataattaggattttctaatgctattgttattccttctattctttttgactgcccgcttgttcctgatacttctccatcatattttgcttcttgccagccgatatcctgtacatgtgtactataacttacatagtgctgtacaaatggtcttgttgttgctcctggtgctcttccacctttttctaccagtacaatctggattgcttctagacgataactatatcctgctgttcctgctgattcaccatttttggcccaatctaaccagccaaattcctgggcatgtactcgataataaatatcatagtaattagccatttgaccaattaactttatttcaatagcttctaatctttttgattgtccacttgttcctgatattgctccattactttgccagttctgccagccgatatcttgaatatgacttcgatattgaataccttcaatattattagtaatatttattctaattgcttctaatctctttgattgacttgttgttcctgaagtcgtaccattacttcgcagatcctgccagccaatatcttcaatatgagtttgatatgttactgatggctttgaaaccgttactctacagcttgctgtttttccattgcttgttcttacagtaattgttgccgttcctgcactttttgctgtaactcttcctgcacttactgttgccacactgctgttactcgttgtccatgttagtgttttactttctgttgtgtttgatggcagaatcgttgcctgtaatgtttctgtttgatttggaatcaacgtcactgttgttttatttaaagatacactcgttattggaatatcattagaaactgttactctacaacttgctgtttttccattacttgttcttacagtaattgttgccgttcccgcactttttgctgtaactcttcctgcacttactgttgctacactactgttacttgttgtccatgtcaatgttttactttctgttgtatttgatggcagaatcgttgcctgtaatgtttctgtttgatttggtgctaacgtcactgctgttttgtttaatgaaactcctgttattggaacagttgaaccaggaacggtaacgttaaatgtaatgctattactatcacttccggtaacattgatcacaattccactattacttccatcactataaaacaatgtattattatcccagccactagttgtcccaatagcttttccaaaagtactacgactattttttgttagtactgcattatttaagtcgccgccacctttacccaatcctgtttctccaggtctaaaaacatataaatagtcttttagccccgtacttgttcctgaaacatttccatccgcttcatttactcctgtatttatacggtagacaactaaaccatcactattagttgtcacctctgggtaaacattattttgtttttcataatattctataacaaaaaattctttatcattataaggagagtatactttaacagctcttttttcactcggattcgtatattgtggccgatttaaagtaactgtggtagaattggttatcgtttgtaattcattgttccatcctaaattattatactcacttgtcatgtatgctaacattccttgtggactataacttgttgtagtcgccataagatcataaaaacctacagggacaccactatcgttataacgatataaatcaggtagacccaaaatatgcatatattcatgaattatagtaccataagttccttgatttaatgagaagacaccgcattcaaaattactatcatatgtattaattaaattatatgtatcgaccgttttattatgtaatttaacactaaggttcattccactaattttatgcgaccataataaatctgaccactctactttatcttcagttaccttatttccttctaagaaaaatgaaattgcatcaacacacccatcattatttttatcaatgtcacttgcggaaagtactctttctatactttcttttgatttagtaagaatctcatttaccaattccctctccctttgggctgcctgactagctgtatatccattaggattactagtactctttttcatataataacctctattatttgaaagcattacagacactacttttccattagtattttgaggaaaaaaatgagttgttgtagtcattttattatatgtatatttttcaacatattctttcattgaaattactggtacttgtcctattggaatttgcatacttgcgttacctgtattcatcaatgcatttgctttatttaaagtcgaagcatcgtccaaatctgtacttgtcatatctggaaattccactagtatagcaatataattattttcttgaatagtactagatcttaaactactattatatgtaattgaatcttgttcatctctttctaaaccatacatttcagtatagtcaactaatcctccttcatgatcttctaataaagaagtatctaattcttcatcttgagcattaactggcattaatgcaaaacttcctattactaaaaaattaactattagtaatattattcctaaatttaattttcgatacatttaattcctcctcctttttataattatcttattcttaaataatatcataattttatctttaaaaccatcaatgatattataatttttcaattaatatttaattccacaattgtttaaactaacaaatagagtataatagttatatatcttcattggaggtaaagtgtgaaaaataattgaacccaatcgtgagtaaaaacacaaaaaaagacgaacttaaaaacaagttcagttttatttagaaaaaacagaatattatttaggaatatcttgaattgttgatacatcaaatccctgtgattttagaaaatcaagtgctgtctcaactgtataattgttcttttctttttgtggctttggattcttaaatgattcatagtctgaaggattgaacttttctccagtaagaatcatatgataaatactgacaagcatcatccttgcaatagctatgattgctttcttgtgtcctcttcttttcttgatttttgtatatttttgaccaaaataactgtttttgtttttgatagctgccaatgcacattgtactaatactggtttaagatattgtccagctttgttgatacgaactgatttcttctttcctgcactttcattattggcaggagaaagtccagcccagcagcatagttgcttatctgtttcaaattgagtcatatcaacgccaatttcagaaatgataagaatggcagacataagctgtattccatctatttctgtaatatgtaaaaaatcatcaaagtatctggaagcacgtttgatgatttctacttcaacagcttcaatatgttgattaagttcattcatatgtgattgaatttctgccattttaaatctttgatctggctcaatttttgaacttttaagagattcaactattttatctttgtttttgcacttaccatgaataagttttgtgattttatcttcatcaataacttcagtagatagaacttcattcatgacggcctgggctgtttttccaaaagtatcagaaacaacagaagccaaaccaatattggaaacagtcatggagttctgataacggttacgttcactagttctcatacagatgagcttaaaacgataacgagagagatcccttaattcacgaatatccttaggcgggataaaagaagatttgagaagatcatgcttgaaaagatcacaaatccatttggaatctttcttgtctgttttcttgcccttgatagctttgacatatttaggatggacaagaacaatattcattttagcttcagtctcaaggacattaaagacagggaaccaatacttaccagtggattccatgcagacatcaaaacattcgtgttcaataagccagtttttaagattatagaggtcaaagttaagagaagagaaatctttctgaatatattcagtgacatgagttttcttgtcagtgataccaatggtagcgacgataaggttcttgtgaacatcaagaccagcacaattaaaacggtggattttaagcataaaaaaactcctttcaaaaaaggagaagtggcattgactgtcagtctgcaaaatatcactatagttgataaaaacaatcttaagtgtccaggctctaagtcctacttgtttgtgcttgaaagactgacggcgacttataattattcaggatattctatatagagtagaattgcctactctcctccacgtgctctgtagtataccacctctcttataggatactacaaaaacgattggatgagaattatttttaataaaatgtttgtgtctgaccgacgaaggcggacggaaatggagggaactatgaaaaatttttacacaggtataaatagatttatgtggcaacattcatttataaaatcttgtactcactttgcatcaagattttgcccatatatgatggtcattttttacttattatttttacttaaaatgtatctaaatcgcccaaataatttactgatattagctgctgaaccaatatgtgttgtttgtatcacattaattcttagagttattattgatcgtaaaagacctactgaaaaatacgattttaaaccaattgacggtagtagaaaaacaggacattcttttcctagtatccatgttgctgcctctgtgtcaattgctttagcagtactaagatatggaccaaatatgggattattattatcagctttatcaattgctattactattgcaagaattctttctggagttcattatattagtgatattgttgcaagtattgctattgcattagctataaatctaatttagaatagcctacaccaatataatttctttttttactctaggataaatgtaaaaagagatttcttatattactaataaattatcgtagtttttgaaatctctttttttattacaaattattccaacattcattagtgcttcatttatttttaatatatttaaaacagtttttcaataaaaaatcaataattatacaaagacacttaaatgcattataataagctgcttaattagattgattgttttcttagtctaattgtgttaaaaaagacaatgttttcagccatattaaactgactcattgtcttttaatttattttattatagctcaatttaatatttctttccacttaataaataataccatgtatttttaccaactattccatcttgctgtaaatttctattttgttgaaacactatgattgctcttttagtcttttgtccaaaaataccatcttcttccaaattaaagcctacactattcaatctctcctgaatcaactttgtaatattaccacgcgcattaattttgatagttggacacagatctaaaagcatagaactatttaaaccgttttcagccatattataatgaaattgattatttaactctttttgcaatcttgcaatccatccatcatactctgttttagtttgattattacaaataataccatcataaattgcctttgcaatcttagtggcccctatatctaaatatctatcagcatcgtcactatcaacaaaacatatttcaattaacatgcttttagcttttgtttttcttattacatacaaattagatccatctttgataccacgattattaaatcctaatgttgaaatatttttgcatatatttaatgcttctggatattcattacctttatatgtatatatttcagttccttttccaccaccagcattaaaatgaattgaaataaaataatctaaatcttgttgatttgataatctcacacattcactaagataagcattttgtgtatttgctttatctactgtacagtcaataacttcattaccactattctttaataattccactaatatctttccaacatttctcgtttctaaactttcattgatgaagccaatagcccctgagcctggtccatttaatgtatgcccacaattaatcgctattttcatctacgcttctgcctctattatcagttatccccggtgttgttggatcattgactgcattccatacactaacaaaaaccaagcttaaaacataaggattacctagagcatctatcaaaacttttaataatgtatcccaagtagttagatcttccgcttttaatccagcataagccaatataggtgttaatactgctaatattaattgaatgataaaaattgggtttttaaatctaattaataagtttattcttttcaaaatgacacatcctttactatgcagttcttttccacatataacatgttatataaggttgaagtcgagttgggatgtttccatttgattctactacaagcgtactatgatttacattggcattagaaactgtatttgcttgtatatttattgaataggtagtatagcctggtacaggattttgagcataatatcctaatctattaccattatttcctgttgcaccaattaacgctcttaaatctgcatctttagcacctgccattttttctactgtatcaaaatcagtatctgttgtgtcaacaccaactgggacacgtccattaccccatctaacccacgtaccgccaaatgttgtttgtggagatgttgatgacgtacttatataaatacaacctacaggatgcattagtaaaaataattgttttgttagtgaggtgatagaattaaatgcatcttttatttcagttatttgatctaaagcaatcatattaaattgtttattccatgatgaggtgttttttaaataaaaatcaccattagtagtattgatataatagtctccactttttcctaatgaagatgtaggcgttgtagttccatttctaataattacaacactattagctgcttcattagcactttgtgtcgcttgagtagcattagttactgctgttcgtgcttcatttgttacacttagagcagtaactgtagcttttttagcctcatttgtagcatttattgaatttgtcaatgctgaagatatttcatcctgttgaagtgtagcttgttcaactagattagttacttgttcttgatggctagttgatgtagaaattaactcattgacagtatttttcacatttaaatcaatataatcacttgttactttgattaccatatcttgccatgtattttcttcaggtaaaatattgccactacctgctgttgcacaaattttatatacaattggatttgtctgaattgtttcatctccattagataacgaaaatgcaatcgctacataaccatcaagttcaaatgcttgtggtggtaatttaaatattccatcagtgatttttaactgaaatgtttttgtatcacgattattttctaaaaaacgattacttaaatatttataatggggtatggcaacataactttcatatttactatcttttataaacttaaattcaatattcccgctaaactgagctggaatatcattaatatcacatgtaagatcatatccctgctgtgtaattgttgaaacgatcattggctcattcctccttctattttttcatttagttcttggattgctttataagcaacagcaagtgcattaataatatttatactattaccatcaaaactaactaatttatttgataatctataatcatcaccaattagaaatcctatttgttgttcattatcttgggtataagtatatatgtcagttttgattacttcttctaaacctttattaaataaatctatattttgtttttcttgtaattcactttgataaattttattagtaacaatattcttagtttcaatgttttctatactcaaaatatctggttttaaatatccgttttgataattattatcatctgttgtaatagaccagtctaatattttagaagaattactattcaaattaaattttaaacttcctgattctgcattcatttgataattactaatacattgtaatcccttatttgtaacctcccagccaccaatagttccatcaatgcactcaataacaatatcttttagaattccctttttaataaatgaagcatctaatttcatatctattccccaggcaatatcaaatggtccatcttttccctgattactaaaagctatgcccttattatcaattctcaaaatattttttgcttcatttatatcatcattatccatataatatgtagctcgcggtttcccaaaactatctgttttagtatatacaaagccaccattattcccattaattgactctactctttcattgatcatttcctgaaaaagctgtgtatttaaatttacactattattaactcgtgatatatcacgattagtggtaactacaatatcagagcttgtcgcgattgttttatctaaagttattttagaattcgataaatcaagataatctttttctaaaactatgcataagaaataatcatctagtttgtgctctttggaaatacatttcaaattatctcctaatctaattttttcaatatcaacttctactagcgacaaatcaattgctgtaattgttaatgacaatgacaatttggtaagttgtgataaatcctgtttagctttttctaataagacttgcggactacttatattttcatattctctagtactatatatccagccatactttaatactgcatcttcatcaaaaatataatctttatcattatttacactttctatagtaattggtaaatctgtttcttgatctttttttcctaatggaattagtgccgttattaaatcaactgatgtaatatattgttctaaatctagaatattttttttgaattttatttcttgggaatttaagtaattgcaattatatgtataatcaagataatttttattattttcttctctaattgataaatatccaccatactgatcaattaaaatatcttgaatactattcattgttgtcattcttttactatctttattattgataagaatattattatcaataatatttccgatataaattcgtttgttctcctcgaccatctggttatgtctatctagtctgctttttaaataagcttcaacagatacatcttcataaaccatcaatggttgaatcgtatcatttaaataacctaatactccttcacaagtataagttcttattccatcaattgtatcagaactatctattactcttcctttaaacattaattcttggccatcttgatttatttcgatcaatttcaatactgagactaatttgttaattttattgtaatgtggatgagtaggaagaagtgtaaaaattaaagtatttgatgtatttactttttgttttaaatctagtttaatacaacgataatcataactagatgaatcatgaattacatactcatcacataataatttaacgatcataatctttcatcctcatcatttaaataatgttttttaaacgggttagcaataattttaatagtaattttattaactagattatcatctctattatctaattcaattgtcattcttccctcataataatattcactatcactagtaataactgcttttactctttttccatgaaacaaattatataatttatcaatatattgatgccatatctcagttttttctatactatcaacattaacagtaatcgttctttgctgataggttggctttccatacacttctgttaaatcaatgtaattgttggaatatggaatagcaatgatattagtaattacttcaggtgtcccaatgttataacttaagattcgcattttaaaatcatcttttaaagaatatttcttttctttaatttcatcactttgatataagatcaaatctatcatgccccatgtcgcccctttctattagtttctctagctaattctacgtctatcgttggagtaattattttaccaacttctgttttatccatatacacatccattttaattttagacatgctggctgctaatttatcataatcaattatttcttcattaatgctattatcccgactaaaagctaaagataaatcatctgtaaaccaagaattagatgtcatagctgattgtttaagttttctaaatcctgaatcagcagcattgatcatatcttttgtagctaaaggcattgctaattcaaaaccaacagcaatcccgctaggtaaatattttccaatttcgtcacgcattttatgagaaggagagaaaatatcaaagaaatcagtaatagcatcaaaaactccagtacacgcttttttaactattttaatcaatcctgttatcccttttgtaaaaccgtcagctataccacttattatatttttacctaattcaagccaatcagtatttttaatagtatctataatttttgaggcaattgtttttgctgtttctttaatattatttaataaactactaagaccattaagaataaacatcatcacatcataccctaatttataccagtcaatttgactaattgtcatcatgaaattccccatcaactctaaagccgtattaattaaattcccaacgatactactaattccctcgataatttttcctaaaatttgttttccactctctaacaattcgggacctttttctattaaaaccgcaataaactgagcaataatttcaggaactctctccaacaaatttggcagggcttcgaaaattcctgtcaccaaactatctaataagttcattcccgtttcaagaactaacggcaaattttcaattaaaccttgaacaagggtcatgatcatatcaaaagcagctggtattaatatcggtaattgctgggcaaagccgttaattaatgctaggattactgttaatgccgtttgtgctaacattggtatattttctattaaaccaagtaatatttgcgataaaatactaaaaccactttgggtcaactgccctgcctgttcatcaatagattcacagagcaatattaacaaatcgcctatcgttttaataatttccggcatcgcttcactaataccattcatcatttgtcctattaaattagaacctgtagctaacatcccctctaatccatctttttctaaggattcttgtaattcatttactgcctgaattccaaaatcagcaattccattaagtggttcctgtaaaccagaaagcattgttactcccaaagtttttacacctgtttcaatagttgttagtttacctggtaactgttcaaatgggccacccatttttaaaactgcctcaactccattttttgtcattgcaaataatgaacttgacaggctagcaattgctttgccagcacttaatgccccttcaccaattgattttaattttgtttttaaagtatcttttttagctattgaagatgttactttatttacattagtgcttagttgatctactgatttattcgaatctagtactgcattatcaattgaatttttaataaagcttgtaacttttgaaaatacacttctggttattgattcaataccttgcattgatttacttaaaccatttgaaactttttgacttactatatctattcctttagctacattatttataagttttgcaacttgataaaccattttagtcaatatctcatcaagtttatttgcttttttttcacttttttctaagctgttttctacttcttttaattcatttttatcacccatataaccatctcctttaataaggaaatgtaatggctcattggctctattaaattacttttccatcttttatttttatttcattttcatatccacattttttacatttaataaagattccagtagaattagcaatatcattaaataacagtaattttttatgacattttttacatgtaaaccagtcttttcgcattgctggtatttttattattcgttttaccataaagcttgtcctataatttcatcactaattgcagttttttcaagtcttaatttattttgaatttttctgatcctagatctttcttttttatcagctatacttgaaatatttatacctcgataatacattctttgtttcaattcacaatctcctaaaccatgaaataaagctaaaaatttaaaccagtgcatatcactttttaataaatcaatctgataatattgtaaaaatgcagcaataaagtaatctccatctattttaaaatcatatatccttacttgtttatctaattcaatattattttctttactatctttttgttcaacattaccttcaaaaaattgtctgattgctaagaaggtttccgtgtctagcggcttaggaatttcatcaacaaaaagatttaaaattacatttgttaaatattccttatcacaattttgattatttaaagcatcgctcaactctatccaatatttaaaatcagtattaattaaaaagtctttgttccgaacagcgatgctgttcggtaaagactcatataatagattaatcattatttataaatgatttatgatgttgagcgcgatttttaggctgtaatgacattcttctaacattcatctgttcattaaccttttcatttaaattcactaaactaataaaggcttcctcatataatctaagattttgtttacttccaaacaatgcaagtgatgtatcaggaccaaaaacatcatcaaaaaatttctgataacatttacaaatatccttaattcgatcaatatctttaccatctttaggcaaattcttgctactatcacttaatttatacattgctttactatacttctctaaaaaatcaacatcttcaaaatcagcttctaattctaatccattataattccattttccttggctcatagactcctcctaaattttatttaaatgttaatgatgttccagcttcatctaatgttgctacacctttaatacttccagatttagattttaacgtacctgtataagaatatgtatcagcattatcaccatcagtacctgggactacagcaaacaagcgttttcttgcttcaaattcgttactattttgtccaactggtgctgtcatatcaacgataacaatttcacgtacagcatcattacctaatttttcatcttcagtaatttctgcaatatcctgatgcacctcattattagtatattgatcaaaagtgtattcaattgatggactataccctgttacatctgtaatttcaccagtttcatcaacatattgacgtgagtattctttaggatttgcactctttgccattgatgtaaatcctgtcattcttaaaaatttatctcctactttataaaaagctacttttttatttcttgttactaaagtttgttctcctgccatttttaattcctcctatataaaactcttaattgtatttgatattttgctgtatcagtttcttttgtttctaaactactatcttgaataacctcaattgcatatacaccttcaatatcaggaaaattatttgcatcgttttgtttttttatccattgttcaaataattcatagaaatcattattttccatatttatactataattactgtcatataatttaattgaagttaaagcaaattgatattgtctaattgtagaaccatcaatatactgtttgataaccggctcacatgaaattttttcaattgaatattcatctgcatcacttccaagataatcaatattaatttttttttgatttaaataaggacatgttagcaaatagtctcttatcgcttttgttatactcattttaatactcctttttactaaaaatagattctgctttttatctattttttattcaaattaataatatctatctgatgcaaaactatgatattttcaatttgctattttgatagattatcaatactttttgtttattttattaatgtaaattacacttacttaattctttataccttagctaagactttattaatatgcatatttttttgtagtaatttcttactacacccatataataacagcaaatgtaaataatttagtcccaaataaatcccaattaaagttctatagattttttacatatataattattaagatcctggtcattaaaaggtgctaatactttatctaatttgttgcaagcattacttaatgttttataatatacagttcttgaaattcctttttccaaagctgtatattctctttttgctgcattatcaggttcattggcatatattaatacacatgttttttcttcattagtaagtattttattgatcgcttcttcaagtcttttgataaaaaattcgtaattataaataataagatcataatgctctattttactaacaatatcttgcatcattttatttatttcttgatgttcatcgtcaataattatttttttatcatttagttcttctcttgttttctttaataaataaagagtatgtttccatcgcttccagttttttaattcatatttactttccttcatcccattacctctttctttgtagataaattgtctacttccaatcaaaaaaaatatataacatttctgctttattcatttctaatatttttgcaatttctattatttcttctgctttgaattctttttcaccatttattttactaattaaacatgttttagaaatctgtaatatttttgcaatagtattcaaagtataattacttcgaacaatataattcattaatttatcggtatttgtcattttttccctccctttttcttagtagaaaaattatctacatatctatattaagattttgtagaaaaattgtcaacacattaaaatatttatattgttttgttgaaaaaaaagaaacataatgttattataataataaaaggaagtgaaaatatatgtcacatatgggaaatagaatcaaacaattacgcgaaaaacataaaatgacccaagatgaattagcacataaattaggttattcatctcgctcatctattaataaaatagaaattggaagaagtgatcttccacaatctaaaatttccttagcagcaaaaattttacatactgatcctgcttacttattaggctgggaagaaaaccttaaaccagttgagcatgaatttgaaaaaatacctgtttatccgcccttatgctgtggtgatggctattttactgaagataatatcattgattatatttctataccaaaaaaaatgttacaacctcataaaaagtattttgccaattatgctatgggtaattcgatgattgaagaaaatattaatgacggggatttgattatttttgaacatactaatatcattaataatggagatattggatgtttttgtattgatgaaaatgaagctacttgtaaaatatttaaacgagatcctgttacatctataattatgttactacctgcaaataatgattttcagcctattattatcacttcaaaacatactggttttaaaattattggtaaacttgctcttgtaataaataatcgccaaaaaaaagatgattaaagctatttaaaatagaataaatcatctttttatttttaatatttaattatattaaaatcataatcaataataattttagtatcttgtctcaaatttcttaaagtataaatcattttgtcttcaggaatcgatatacatcctccagtagcaccttttccactacaatgcaaaaatattgctgatccctttccgacaatctgctccatattataaccaaccgcaagacaataattataaacattaccataatcaataatatgctcagatcctgcaggattatagttactaatagtagaggcatctaccaatttattgtaatattcaggatcaccaccaccccaataatgattattgttcacttgtatataacctagtggacatccaggatccccttttattccaaatggcgtatgaagagaaaaaattcctgtaggagtttttccatcaccttccgctaatttgttaataccattttttcctacacgaccaagtactgaataattatccatccaatatccatccgcatctttactatgcattgaaactgtcgcatagctgccattaaatactgatacaattattaattgtgaactagtttgagatgcctttaaatttgcaacccatgaattatatttataaaaactttctttagtatcgtcaggagtttcttcacccttctctattaattttacttcaactgcttctaaacggtaattatatccttcagtccctgctgattctccatttttagcccagcctaaccagccaaatttctgggcatgtactcgataatatatatcatagtaattagccatttcgccagtcaatcttatctggattgcttctagctgttttgcctttccaattgtccctgatatctcaccatttgctttccaattactttcccagccgtaatcttctatatgtgatcgatattgaatattcccttgatatttaggattctctaacgttatctttatcgcttctaactgtttggcttttccactagttcctgagattgctccatcaaatacttttgtttgccagccgatatcttgtacatgtgtgctataacttacataatgctgtacaaatggtcttgttgttgctcctggtgcttctccacctttttctaccagtacaacctggattgcttctagacgataactatatcctgctgtccctgctgattctccatttttagcccaatctaaccaaccgaattcctgagcatgtacgcgataataaatatcatagtaattagccatttgaccaattaactttatttcaatagcttctaatctttttgattgtccacttgttcctgatattgctccattactttgccagctctgccagccaagatcttgtacatgacttcgatattgaattgaacctgaataaagcggattttctaatgctgttgttattccttctattctttttgactgcccgcttgttcctgatacttctccatcatattttgcttcttgccagccgatatcctgtacatgtgtactataacttacatagtgctgtacaaatggtcttgttgttgctcctggtgctcttccacctttttctaccagtacaatctggattgcttctagacgataactatatcctgctgttcctgctgattcaccatttttagcccaatctaaccagccaaattcctgggcatgtactcgataataaatatcatagtaattagccatttgaccaattaactttatttcaatagcttctaatctttttgattgtccacttgttcctgatattgctccattactttgccagctctgccagccgatatcttgaatatgacttcgatattgtacacttcctgtgtattctgtatcattaataatatttattctaattgcttccaatctctttgactgattcgttgtacctgataattctccatcttttttactattttgccaaccaagattttgaacatgagtttgatatactatcgataatttatctccatctttaattgcatatactgataaattataattattgattactaaacctgctattaatattatcccaatgaatttttttataattttcattttaactctctcccctatataaattataatctaagataaattattttctcttttaatctgatctattaaccttttcatatgtgcttcaaacattacatacattccaatatatatcatttctgcaattaatgtaaaagaaatcataataacaactattgaagctagtggcccatacacatttgtataatcagctatactaaagtaaaattctaatcctgataaaagaatcaataataacaaacttgcacacgcagctccttcaataacatccaaaatatggacacggacatcaggaataattttatacaacaagaacaaaataataaaaaacataaaaaataaatacaaatcttcaaaaataaaaattttactcaaatcaacaaatgagttgattactggtataaatgtcaacaaagaaataattaataataataaaacaaatactgcgattgtttttaacaacataataacttgttcaactataaaatttctttgatggtctgatggaaataaattttttgaaattccataaagttgattgattcctctactaactacaaataatgagatgcaaagcacgatcatcgatgaaaaagtaatattatttgattttaaagatgatattattatgtctgaaaactctggcgttaaataattttccaacattttttcaaatgctgttaaatcaatgtttagtatcgatgccagaaaagcacataaagaacaaattggaataatagacattattaaataatatgcaaagcatattcccgcatttttatttactttatagcgataatctaaaatgcgattatttattttattataaatttttattattagctctttcataaaatattctccctgataacctttaattaaagtatatcttagaaataataaaatgcaaatactcaaaattaaatttcctgggtaataactatctttttttatgtaaatattttataatatgaacatggaaaaattatactcaacaggtgaatttgctaaaatagctggtgtcaccataagaacaattagatattatgacaaaattggcttattaaaaccaacgatgatccttgaaaatggttatcggcgttattgtaataatgaccttattacacttcaaaaaatactttcattaaaagaattaggcttttctttagaagaaatctatcctttaatacaagatgatgataaagatagttttaaaaaatcaattcaattacaaactactctcattgatcaaaaaatacaaaaactttctaatttgaaagaatcgttaaaaacaactgaaaaactgctaaataaaaataatattgcatgggataaaattattgaattaattaaattgtcctcaattaatcaaaatatcatcaatcattatattaatgctaaaaatcttgaaactagaatcaaactacatgatcaattttcaattaataaacaaggctggtttccctggctatttgaacaaattgatttttcaactgtttaccgcttattagaaattggatgtggtaatggaaaactatgggattataatacttataatttgcgtaatcgagaaatctttttatctgataattcaacaggaatgatcgaagaagctaaacaacgtcttggaaatgattacaattatctagttgttgattgtcataatattccttttaagaacaactattttgatacgatcattgctaatcatacattattttatttaaaagatcttaaacaaagtttaaatgaagtaacaagggttttaaaaaaggcaggtactttttattgtagtacttatagtaaaaaacatatgcaggaaattagttttattgttaaaaactttgataatcgaatatgtttatctgctgattctttaccggagcgctttgggttagaaaatggacaaaaaatattatctaaatattttagttttatagaattaaaaaaatataatgattatttatttatcactgaagcccagcctttaatagattatattcttagttgtcatggtaatcaaaatgagtttcttggtaatcgtttaaaagaatttaaaatttatatagaagatttaataaagaaaacaaatggcattaggattactaaagattctggattatttatttgcacaaaataaaaactagaaattattacttctagttttatttttgtcttatttaattattttacttttccagcatacattttttcaaaataattttgatattcacctgaaagaatattttgccaccattctttattatctaaataccattgaatagtctgttgaattccagtatcaaaattatatttaggcttccatccaagctctgtttctaatttagttggatcaatagcatatctacgatcatgacctttacgatcttcaacaaatttaattaatgtttctggtttatctaaagcttttaaaattgttttaacgacttctaaatttgttctttcattatgtccaccaacattgtagacttcaccaacacgaccatttctaataattaaatcaattgctacacaatgatcatatacatgtaaccagtcacgcacattatcacctttaccatatactggtaattcttcgtcagctaaagctcttgaaatcattaatggaataagcttttctgggaaatgataaggaccatagttattagaacatctagaaatagtcactggtaaaccataagtacgatgatatgctaaaacaaataaatctgcagaagcttttgaagaactatatggactagatgtatgtagtggtgttgtttctgtaaagaataaatctggtcgatctaaaggtaaatctccatatacttcatcagtagatacttgatgatatctttttacaccaaattctttagctgcatctaataaagtagttgtccccataacatttgttttaacaaagatttcaggatcagtgatacttctatctacatgagattctgctgcaaaattaacaacaatatcaaatttttcatctgcaaataatttgaagataaattcacgatctgcaatatcaccttttacaaatttataatttggtttcccttcaactggtttacaagtttccaagtttccagcatatgttaataaatctaaattgacgatcatatcttcaggatgattttcaaccatataatgaacaaagtttccaccaataaatcctgctccacctgttactaatattttcatttaattattctcctttgtatacaaattgattatttgattcttctagtgtcggaccagtcatatctttttcactcaaaactggttcaattccatttaataattctccccaattaacattggctgtagggtcatcataacgcattccaccctctgattctttattataaacattatctactttatatctaaattcaacgttttctgtcaaagttaagaatccatgtgcaaatccttggggaataaaaaattgtcgatgattctcttcgcttaattctacagatacccattttccataagttggactacctttacgaatatctaccgcaacatcaataacttttcccttagtacaagaaaccaattttgattgagcataagggggattttgccaatgtaaacctcttaaagtacctttttgagcactaaaagacatattatcttggacaaaatcaacatcaattcctaattgttgatattttggtttagaataagtttctgtaaagtatccacgatgatcaccaaatacatcagtctcaataataattacaccaggtattttagtttcaatttttttcattatcattactccttattgatctataaacttaccatctaatacatcttttaaatatttaccatattgatttttcttatataactcataagatgtatttaattggtctttagaaatccagccattattataagctatttcttctaaacatgcaattttacgattttgatgagtttctacagttttaacaaaattagttgcatcaactaagctttcatgtgttccagtatctaaccatgtaaaaccttgccctaataatgttacatctaaagttccattatctaaataaattttatttaaatctgtgatttctaattcaccacgagcacttggtttaatactttttgcatactcaacaacatttttatcataaaaatataaaccagttacagcataatttgatttaggattagctggtttttcttctaaagaaactgcttttccattttcatcaaactcaacgacaccaaatctttctggatcatctacataatatccaaatacagttgcgccactatatttattagctgcagctcttaagcgttttcctaaaccatgaccatggaaaatattatcacctaacaccatggcacatgcttcaccatcaataaattcttcaccaataataaatgcttgtgctaaaccatcaggagaaggttgaactttatattgaagtgaaattccaaactgactaccatcacctaataattcttcaaatcttggcgtatcatcaggcgttgaaataattaaaatttctttaattcctgcttccattaatatacttaaaggataataaatcattggtttgtcataaataggtaataattgtttacttgttacttgtgtaagaggatatagtcttgttccagatcctccagctaatacaatgcctttcatttttaagcctccttattttcatattaatattaaacccttacgttacgttatggtcaagtaaaatattaatattttttatattaccaattgtattgaatcataaacatttataggataaaatatttaaaggtataaaacaaagaaagagtgactatatgaaaaatataaaaaatattattggaattttaattggcaatactatttatgccttaggagtaacaatgtttatcctgccaaatgatttaattacaggtggaacgactggaatggctatttttttgaattcaaccttcaatattcctatcactatttttgtttctgtatttaatattagtatgtttttattaggatggaaaatattaggaaaaaaatttgctttaactactttgattagttcattttattacccatttattttaggtatactagaaaatatttttaaaaatgaaatgatgagtaatgatactttattatgtgtaattttagctgggctgatgattggattggcaattggtatcgttatacgttgtggtgctagtactggaggaatggatattccgccattgatattaaataaaaaattaggtattcctatatctattagtatgtatagttttgattttttaattctattaagtcaaatgatcattcgtgatcgtgaaatggttttttatggaattttattagttcttatctatacaattgtcttagataaagttcttgttattggtaaagctcaaatgcaaataaaaatcataagttctaaattttctgaaataaatgaaatgataatcaataaattagatcgtggttcaactttgattcacggagaaacgggctataaacataacaaatatccaattgttttaactgttgtaagtaatcgtgaattaacacatttaaataattatgtttatgatattgatccagatgcttttatgattatcaataaagttaatgaagttagaggtaaaggttttacaactgaaaaaaaatacgaaaaaaaataaaacccatacttaggttttatttttttaataatggataaatactgggtcaccacttctaactaactcatagactttttgtgcatcttcatattgaagatttatacatccatgagatcctttcgttaaatatagggttggtgaccagttggcccagtcacttctttcaagataatgatatcccgttcctgtccacatgatacgaacccagaattttgaaggagtttgataatcttctccaactaataatttttctggcattttttctttaacataccaaataccagtacgcgtaattcgatcctctgttggtggtttccctgttacacatatacatgaatgaacaagctggccatctctatacacataaactttttgctcagttaaatcaatctcactatagttttgtgtatcccaatcattttcaaaattttcgtaatcttttttataacctttattgctataaattggttctaattcagttgttaaggcttttttgttttctttactattattttttatataggcatctattaatttactatctgtttctttagtaatttcttcataagcttggtcaacaattttatcataatctaatcgccagccataatcaccaccagataattcaataacttgccctgaatgagtcgtaaaattacgtttttttccaactgttttatattttaagcaaaatgcttcgatccattcactcatagcatctttatcaaaattgactttaccatcgtcattgatcgtaatccaatcttttatatcatctggtgttattgtttcttttacaccttcacccatatcccaagtaatccaatttaataaataattgttatatgtttcaagctgtttttttaaatccttttcatcaatactgtttgaagctgttatataaatatcagggtaacttttttcatcatttaaatcaattttaggactaattttgttgattgatttttttatcaaagaattaaaattttctaaatttaattcatttccatctattccttcaattatctttccactcttcgtttcttcatcatattcaacatgtggttttactgatgctttaatctgatatgtctcatttccagcaaccaatacagactcattaattatttgctctaatttagacttatcatatgatactttcaaatcaatatcatgatcatgatttgaaaatataccaaaaatacccctactatctttatgatcagtaaaatccttttcaagattttcatcataagttactgacaaatcaatatcagtacctttaattttaaatgacaccccttctttaccaataatctctaaagaatagtttttgatagctttttcaaatatctcttttgattcctcataagtcatattagaaacatcgatactatttatcgttgtatttgggtaccatttattttgataatatattgatgtcccaaaatacaacaatacatatcctaataaaatagctccaattacctttattctttttcttactcttcttctctttcttttcatgatatttgaataacatactcctctttaaatcattttaattttattaatctttattttatgacattatatcacaaaaaataatcgaatcaattaattcacttctttaaaacaaaaaactatatttttctttaattacatataatttaatttaaacctttaacatcactttctgttaatttttctccagcttcaatcttatcaattacctttattattttatttaaaactttcttatcaggaacagtaatatatgttttctttcccttttgagaatacatatcatacgatattttaccttctcctgttacttgaacattaaaaatatcccagtcagccatatcatctaattgcatatttactaaagatttaatatcatcacttgtcatatctgtttcaaaacttccttcaacagctgctaaaatattattataattagtaataatcttcggcgacatagctttttttagcattgccatcaataatctttgttgattttttccacgatcaaaatcgccacctggtaaagcataacgttctcttacaaaacataatgccttatcaccatccatttcatttactcctttttttatctcataattgccatgtaaagtagtaaatttatatggtgattcgacttcaactccacctaaagcatcaataatattagttattccgctaaaatttgttttagcataataatttacttttaaatccaagaaatcttctaacgttaaaattgtttcattaattccatacattgctgaatgagttattttatccatttttccatttctatttaaattaacttgagtatctcttggaacactaactaacaagacctgtttttcaattggattaacacaaacaactaaattaacatctgcccttgaaatagtcgatactgatccgtatgtatcaattcctgttaaatatataataaatggattttctgttacatctgtctttgtggtaacagcttcaattttttcttgtacttccattttataaattactcgtgtttcatcactaaaactttcatgatttgtctctaatacacctaaatacgattgatcagcaataatacaatcaactttttcatcatataatgcatcagccagttctgcataatcatcataattctttttttctggtgtctcatcaattttatcttgaatttgagcaagtgcatcagttatttcagaaatactcttttcattctcaattccaaaagtcttcccttttagatcttcaacattttttatattactatctttcattgcatatatagcaataacccgagtttgcataaatgcacttgtaatattgcttataaaattatctccaattgatgcataaacactacctacaataaacaatgctgacaataaaatacttgttaatttactaaagaatattcttgaacgtgctcctgtacgacgtttttttctagcaccagaggttatccaaatcatctctattaaaaataacaaaaataacactatcacaattataaaataatacttagatggcagcattttgagtacatacacatatcttagaaatactattgatgtaattaactgtaaagttaatattattcctttggaagtaagtttagaaaataaactctttttctttttttttctcacaatttttcaccccataaacactcctatcttaacacactagtatgtcatatcaaagagaaatttagcttatatagaaagagcttcataaagaagctcttttagtttcctaatccttctatatcatcctcattgatttcgccaccttgctctacagtatcaataagttttttgatctttttaacctgtttcgtatctggtttcataacataaacttctgttccccacattgaaaacgtcttagtagttttatatccctgaccttgaacttggacattatatactgaccagtcagccatatcatttaactgcatattaagtaaagatttaatttctttacttgacatatcagtttcaaaacttccttcgattgcacttaaaatgttattaaaattggtaataattttaggtgacatagctttatcaagcattgcttttaatactttttgttgatttctaccacggtcaaaatcaccatttggtaatgaatatctttctcttacaaagcataatgctttgtcaccgtccatttcatttattcctttttcaatctgatagttaccatgcaatgttttaaatttataatcagaatctactgtgattccccctaaagcatcaacaatatttgtcattccactaaaattagttcttgcaaaataatttatttgtacatctaaaaaatcttcaatagtgctaattgtttcacttgtaccataaattcctgtatgtgttaatttatccatttctccatttttatttaattcaatttcacaatcacgagggatacttgtcattaaaatctgttttgtttttggattaacagttactattaaattgacatcacttcgagctactgtattaacacttccatatgtatcgatacctgttacatacactgtaaatggtttttctgttacatctgtcttttttgttgtaacacttagtttagcatcatattcataagattttataatctttgtatcatcatcaaaactttcatgattagcttctaacattgatttatactcttgcccaacaattattgcatctactttatcattatataatgcatctgcaagacttgaataatcatcatatttagttaattcttgttctcctatttcatcttccatatctgatatagctttagctatcgtagttgaatcattctgatatgaaaccccaaaattttttccatctaaatcacttaatttattggcttcattatttttcattgtaattacggaaattaaatatttttgtgttttagcatcagatacattatctaaaaaattattactcctaattgcataagctgtacctatcattaatataatactcataatcaaactgataatttttgttatgatcgatcttttactatgtaatccttgtttttgtcttttttgaccgcttctcataataaaaaagaaaattataatcagcaaacatggcacaattgtaacaggagctaaatattttatcggaactaaatctaatttaaatataaaatatataaatatcgcagttgcaattaattgtactgttaaaatcaaatatttagaagtaataaattttataaacttattttctttcatatttcctcctctatttcccttctattttcaaataataccatattattttttataatacaaatttatgttgaatttataataaattttaagatttttgtaagaattatattcaaaaatacttgataatgaaattatattgcacaattttaaactatttaggttataatatctattgaaaaatattaatttgttaattatattttttatccttatatagacattcttacttagtggcatctaaatattaaaggattttataaaatattatttttagatttattattatacagtttttttataaaatttatagattcgacaactatcgtgaatatctttaaagattcgtgaatttttcacgaataaacacgaaaagtttacatatattaaaaattaagttcactagttttctaaatctcagattttctataaataaagccttttatctttgttactgtataaatataataaattttgtcactaaaacgaaaggggaatacaaagatgacagacgtaaaaaaatacacagtttatattttagaagaaaataaagatctattaagcagcatcaaagatagcttgattaaaacaactaactttacagttattggtactagtgataatgctactagttgtttaaattatttatcaacaaatagctgcgatttattaattattgatttaatgcttactaatattgatggaattggtgtcttaaataaattaaaagaggttaatagtcgtgcatataataaagtggtatgtattactagttttactaacccactaatttgtgaaactttagaaaaattaaatgttagttactgttttaagcaaccattcgatatcacttattttacaacaacattatcttcaataatgaaaattactttagaagatattaaagacatgactcaagatgagtccgaaaaatataaaaaaatcaaactagaaaatgaaattacagaaatattacatgaagttggtatacctgcacatattaaaggttatatgtatttgagaacagctattttatcaacttattataatattgaattattaggccaagttactaaagtactttatcctgatatagctcgtcaatatagtacaactgcttctagagtcgaaagagctattcgtcacgctattgaagttgcttggaatcgtggtaatactgatgcaattgatgatatctttggctatacagttagcgccactaaatctaaacctactaattctgaatttattgctatgattgcagataagctgcgtttagagcatcaaactaaggcggctagtcgccatagttacttataatatctaaatttaatataaatagaagaattaaaattattgaacctatcaataaaattaattctttttttatctttatttgaataataaaaaaacagttttaccttaattagtataaaactgctaaatttgatacttttataaaaattagtaattatactttgatattattaaatctgcgattttagaaataaactctgaattacataatttttctttagctctaaaaccaaaaatattttgtaactcttcttgattcccatttgaccaagttactttaatgacatgacgtatagcttgttctactctcgaagcagtagttgcgtgattcctcgcaatactaggatacaactcttttgttatttcacctaataaattaatattattacaaacactactaatacccgttactaaataattgtatccttttaaatggcgtggtactcctatatcgtcaaaaattctagtaatttcactctttattattacattacgatgttctttatcatctgcaaaattatctttagtaatacgatttaatatttctataaagtaatctagattaaatggttttcttagacaataatcaattgataactcatctatcatctcaaatactactgaattaaaatcactaatacagattaattttttaaatcctttaggattatcttttcttagctgattaataataccaacaccatcaatatttgttaacattaaatcaattataaaaatatcaacttcatgctctgacaaatattttaaacattgtatcccattttcaaatgcagctattacctcataatttcctttattattaattttattaatcaaactatctttcaataaatgatcttcttctaaaattacgatatgttctttctcgttcatttttaataactaagtgttgattacacttctcctccccattaactttatcctgctttatagtattttaatataaaatcatattttctattcaagctctattaatttttaatatatccaaattttaatatttcaaatatataattttaaaaactgcttttcttatataaaacaacagtttatctataaatttattgctttaaataaaattaccgataaataaaactcgaaaatacttttaatatataaaaactataaatacatccttatttactttaccccataaactaaaatatcttatttttactacaaaatcaatacttttattagccatttttttatagaccacattggccgtttatttgaataatgcactacctattcttatcattgtagcaccatattctaatgctatttgataatcattagacattcccattgataactctgtcaaagagtaatttttatatttattttttaattcaattaacaaattttgcatcttttcaaaatacaccctagtttgttctggttcaatattaggtgccatcatcatcaatcctttaacatttatatgtggataattatttaatatatcaaatacctcatcaatttcttcaatttcaaatccgtgtttactttcttctttagctatattaacttgtatcaaaatattcataactaaatcatgtttttttgcctgtttttcgatttctttgattaaagaatagctatctactgagtgaatcatagtaaccttatcaataatgtacttaactttatttggttgtaatgtacctatcatatgaaattcacattttccatgataattttcatacttttctaaaaatgcttgtaccctattttctccaaaatatttaacacctaattgttctaacttattaatttcttctataccgacatactttgttgcagcaactaattttgctccatttaatttatctaatacttcttttaccgcttgctcatttacatgcattttagcatctccttatatcttaatttattaatttatatattatcattaattatccatttattacagtaatttttttattttatttatacttttatattattgttataataatataaaaaattataatttctatctgtcctttttattttgtttaatctgtatatttaaaaatatacagtataatgttaatatgttcaatgtaagggggattttaaatatgaattataaaactttaaaaattgctactgtgggtttaatggctgcattagcatatgtatcttttacttttcttcaaattaaaattactactccaggaggaactacatcttttcatttaggaaatactttttgtattcttgcagctcttttattaggaggagttcctggaggattagctggagccattggcatgggaattggtgatcttcttgatcctgtatatattacttatgcacccaaaacgataattttaaaaatgttgattggaattattgcgggaatagtcgctcatcgtatttttaaaattaataactgtaaaagtaaatctaaattacttatttatgtaatagtttctgctattgcaggtatgttcttcaatgtaattggtgaaccattatttggatatttctataattctgtaattttaggtgctccagagacagctgctgccacattagctagctggaatgctattacaacttcagtaaatgcaattattactgttattctatcttctataatctatataattattagaccaagattaataaaaagtaatattcttaaaaaattagcacctaaatacaaagaataatattataattttttttaataaataggatattgcactaaacatttgattaatgaaataaatataaagaccctttaagggtctttataacttttttatctattaataaattattaaaatttttctatattcatcatttattttatctttcattaactaatttaaatattcttttattaaaaaattttattttatgtcatcattttttatattttaatattatcgctatatgataagctttttatatctttttactatttttgtagctgctagattataattattatagtatgaaaacgatcttttttgattctaaagctttattgttgccacatgtatgcatgtggcattttatttcacaataaaagaacagttacatatatatctgttctttatattaattaactatttatttgtctttaatgtatttttgttccattcggtaaattcttaacacttattacttctaataaaccttttttatcaccggctaaaatcattccttgtgattcaattcctctaatttttgcaggttttaaatttgatactacaataacttttttccctacaaattcatttggtgaataatactcagcaattccacttacaatttgacgtacttcatttccaatatctattttagaaaccaataatttatctgcttcaggatgttttttcgactcaatgacagtaccgacagttaattcaacctttttaaaatcatctattgttataaaattaacatcttttttcttttcttttttttctggctgtaatgcagctattttcttttctatttcttttgggtctaaacgtgcaaatagcatttctggtttttcaattactttagtcccttcttgatataaaccaaatttatttaagtctaataaacttctttgatctgtatttatttgatcaagaattttatttgctgttgaaggcataaatggaattaaagctacagcactaaaacgaatactttcaattaagttataaagcactgtcgccaaacgatctctcttactttcctctttagcaagtgcccatggcattgtttcatcaatatatttattagttcttcgaagtaatgtgaaaattgcatctaatgcatcagatgatttaaaattatccattttttcaattactttttttggcatttctaaagcaactgtgattagttcttcatctatttcttctttaacaccaggattactaacaacaccactaaaatatttattagacattgcaattgttctgtttactaaattacctaatatatttgctagatctgaattaattctttcaatcaataaatcccaagttatgcttccatcattatcaaatggtatttctcgtaaaacataatatcttacagcgtctacaccaaaaatatctactaaatcatcagcataaataacattaccttttgacttagacattttactttcaccttgtaataaccatggatgtccaaatacctgtttaggtaaaggtatatctaatgccatcagcattataggccaataaatcgtatgaaaacgtacaatatctttaccaattagatgtaagtcagcaggccaaaatttattatataattctccatgatttccatccacatcatagcctaaccctgtaatatagttagttaatgcatctatccatacataaacaacatgcttaggatcaaaatcaacgggaattgaccagctaaatgatgttctagatacacaaagatcttgtaatcctggttttaaaaaattattcatcatttcgttttttcgagatacaggttgaataaactcaggatgtgtttcaatatgatttattaaacgttctgaatatttagataacttaaagaaatatgcctcttcttttgcttcgttaacttttccaccacaatctgggcagttaccatctacaagctgtgattctgtgaaaaaagactcgcatgcagtacaatatttaccttcataatatcctaaatatatatcacctttatcatacaattttttaaatattttttgaacttgctgtttatgatactcatctgttgttctcataaagcgatcataagttgtgtccattaaatcccaaattctttttacttctgctgctttttcatcaacaaactgctttggatctatacctgcttcttttgcctttaattcaattttttctccatgttcgtctgtaccagtttgaaaatagacgttatatccttcttggcgtttaaatctagctattgcatcagctaaaattatttcatatgtatttccgatatgaggcttaccagatgtatatgttatagcagtagttaagtaataatctttttcatttttcataatcaataatctcctttcaaataaaaaaagtccttacaaaaggacgaattatcgcggtaccaccttttttacacatatgtgtcactcaatacttttaacgcaagttacacggttatctttaactattcaagataacagctccgggcccatcacataaagctaaactcttagtttccaccacccactaagtctctataagtgttactttaacattttcccttctttgctttttccactattaactttaacaaacaatccttctaaagtcaaatcaaatttaattaggataataatcttattatttactattttatattaattattcaaacattatatttatagttaatgtttcacgtgaaacatttaattatttctagtttgatttagttctaaataaattttttgcatttccatatccgtttttgccatcatatcagcacaattttttaatcttctttgaatttgtatatttgcatctttagttcccttataaactaattcatgttctaaagaagcccagcaatccatagcaatagttctaatctgtatttctacaggaatataaataattccgtttcgttggtatactggtacttttattattaagtgtaaactacgatagccattatttttaggatattgaatgtaattagattgttttatttggataacatcatcttgtaagactaatagttgagctatatattgaatatcattaatataattacatattaccctaagtcctgcaatatcatttaattggcacattccttgataattttgttccaatccttttctatttaatttttctaatatactagctggtgatttaattctactttgtatagcatgaattggactatattgataattcaatttaagttcttcatcaattatttctaactttgtttttacaatttttattgctgctttatatggttgcattagtgtttcaaaatctgtttcatgttgtttaatattaattatatctttattcattatttttaccgaatgtagtattcggtacctcctttttattaaaatttttatataattaaattcattctacagattattatattaaatatttttatcattaatacatcaaaattatggatatttatgttaaataaaatcttaaatttatacaattagattcattatataaaagtagttttattaatattttataacttaaattattattttgattaataaaaaagatctaaatagagtaatagactctttatagatctctttcttaataatttgataagtatttttaaattatctaaaaaactattttataacactctttaattcaaaatattgttgtaatgtatctaatgtaacgaattgatatcctttattatttaattcttctaatgctaattctaaaccatttattgtaaaactatgaatatcatgtattaatatgacagcaccatcaaatgctttatttacaattacatctttaattttattagcatccttcaatttccagtcttcagtgtctaaattccataacgcaattttcattccattcttcgatatagcctctttaactgtatcattaattgaaccaaatggtggtcttataaatttaggttcatatccagttattttaaaaattgcatcttgggtatctacaatttgtttatttactccatctatatctaatttttttaaatcaggatgatcccaagaatgacttcctatttcaaaaccatgttcatatactgtttttacaacatctggatataactcagcatttttccctagcatgaaaaaagtagctcgtccattatatttttcaaataattcaattacttttaaagtattggttttatgtggtccatcatctaaagttattgctaccatttttttattagtatctatttgtggttgatctgctggtttaactacatctaatggcgcattagaaggaatattcttatttgcaagttttattaaatctttattgtcctcataatttatttcaactttattttttagttcttcatcactataaataaccaattttttactttctacaacaatacttgaactatttgagtcaatattttcaattccgctaatactagaagatagtacacttttataattatttcttaaacaatcttcgactgttaagattttttcattttttaaatcataagttaataatttattagttgtagaaattacatttacattttcatcatatctatttatctttaaatttaaattaatatattgattatatacctcatttattgaataatccatatatataatatctttacttttcttattttctttttgctcttttaaataattttcgtaaaattcattaactatcttatttaattctttactttctgtttctggataatacatggatatatataaattatcactttcatctttatagtgttttacttcaccaatacttttgttatcctcactatattgattaaattgatcatatatactatctttattaaagaaatagaatattccacctataacaattgcaactatcaacaaaattattattacatattttatttttctatctgcttcatgtgatcctcttgcataactatatttcattcattttccatcctttcacctcttatataatactttatttgtagaattaaatcaaattaatcgtttttataaaatttatatatatttaatgtttcacgtgaaacattaagcatataattaaagttaaaaaaagacgatttactcgtctttcttatgatatgctgcataaacttcatttttcttaatatttcttaatttagcaacttcttttattgaatcctttactgacatacctttagcaacatattcattgacgtgttcaacaatagtttgctcaaaaatatgttcttctataacattaacattaccagaaactacaattaccatttcaccttttaattcatctataatatttaatacttcacttattttacctcttataatttcttcatacttttttgtaatttctctacatagagcaatctcgcgatctccaaaaatttctaacattaattttaatgtttttgcaattcgatgtggagactcatacaaaactaatgtttcttgatacttttttaaattttctaattctttcttctttttcttatcctgatgatctaaaaaaccataaaatataaaaggttgcggaactattccagaaacaacaagagcatcaagacaagcatttgcaccactaatcggaataacatttatttcatttgcaattgcttcttttactaattcaaagccaggatctgatatagcaggatatccagcatcactaactaatgcaatattattaccttctaatagtaaattaattattttaggaatagaatgtataatattatgttcatggtgcgatattaattttgtctttatattataataatttaataatttgacagtattacgtgtatcttcagcaccaatataatctacttcttttaaaattcttattgcacgatatgttatttcttctaaatttcctattggtgtcgcaacaagatataaacatggatgattattttcaaaacttttttgtctattcatcaattttttctccaaacattttccttacttcattgctataagtaccatcttcattatgagcatataatggtggctcaatttttaatcctttttttcctttatatattccctcaactaataaaacatggcttgcacgaccatatttaggatatacaaatcttattcttttaggttctatttcatatttctgcataatatttaaaatttcaatcattctatcaggacgatgaaccattgcaaacttgccacgattatccaaaatttttgcagcacttttaataataccttctaaatcaatttttatttcatgacgtgcaatactcaaaaattcattttcatttatattactatcttcatctactttaaaaaaaggtggattacatacaacaagtccaacttttgaagccttttttgcatattcacttatatcatcatgaattatttcaatttgatcctttaagtcatttaatataacatttttctttgctaattcaactgcttctgattgtatttctattccaatgatctttttatctgttcttgttgataaaagtaatggaattgctgcattattagtgccaaaatcaactattttcttaacatctttagtaatagtgcaaaagttagctaataatactgtatccaaagaaaagttaaacatatcttttctttggattatcttcatatgattaaaagctaataaataattagttacttcattatccatacttaattattatccaaacgtttaaaattaatttcatttaatccaacaaaaattatcgcaccattattatctattttaactaaatcattaattacattaagacctaataccttaacatctttaccttcatatttcactctgcttcctattttaggaaaacgctgcttttcaatcgtataaacttcatcttcatattttaaacagcacattagtctaccacaagcaccagatattttttctatatttatagctagcatctgatttttagccatatttatcgatacaccattaaattctccaaacaaagatgtacagcacaaaggtaacccacatgttcctattccacctattactttagctttgtctctaggaccaatttggcgaagttcaatacgacatctaaaaactgttgctaattcttttaataactctctaaaatcaactcgttcatcagatgtatacataaaaataactttagctttatctaaggtgaattcacaattagtaagttgcatatccacatcatatcttgacactatatctctacaagttatcaaagcttcttgggcatcaattaaattttttttatacgcttcaacatctttttgatctgctaaacgtaaaattggctttaattctgtatcaagattaaatttttctatttccattaattcttgtgatatttcacccaattctagtcctctagctgtttctacaactacatagtctcctttttttaattctaaatctgtagaaaaataatatacttttcctgcatttttaaattttacacttgctaatctaagattttgcatagtaacacctctctataatctatacataaaactatccattaataatgcaatattagcattactttctatagtataaatagtctctaatactaattctatttgttttattaatatagtttcttcaacattaataattttaaacaaatctatattttcagaatataacactttttgattatgtttcacgtgaaacacatccttcattgctaataataacatattcaaaaataatttaatatcctcacgctctttatatttttttaataaattagtctgagtattaataattaaattattacgcttaaaatataaatcttcaataaaatttattacctgtaaatacatataattaaatcgatcatcatataatttttttgcttcatcaacatcagctgctaaaaaagctaacacattagcagcatcattaggaatattatcattaatcaattgctctgctatactttctttactatctggttgtatatctattacttggcatcgtgaaataatcgttggtaaaactctattaatattttttgtcgtaaataaagcataaacaccttcatttggttcttccaacatttttaataaagtgttcatcgcttctttagttgaatactcaatattttcaattatgtatatctttgcttttccttctaatgaagactttttaaatgtttcttgaattttttcaatatcacctttttttattgaagcaatatttccatctaatttaataatatcactatatttgttttccagtactttccgacaatcattacatttcatgcaagctaaagtttcatcgcaaattatcgacattgctaaaaaatttaaaggcttttctgtattatttccaactaataaaaaagcatgtggtattctattttgtgaaaattcattattgattagatgataaaaaactggctgaaattttattaaataatctttcataacttatccctaattatttttaacacttgacttgctacttcatcaattgatttacttgcatcaattttaataatgcggtttgaatatttattacaaatagttaaataaccatcatatacttttttatgaaaatcattagattccaaatctaatctgtccatatctctattgttcttatttattcttgccaaaccttgttcataagatatatcaaaaaatattgttaaatcaggaatagtatcaccaattgcaaatagatttatctgatatacttcatctattcctattcctcttccaattccttgataaactaatgaactgtccacaaatcgatcacaaataactatgtatcctgcctctaaagcgggactaactttttctactaaatgctgtcttcttgcagctgcatataataaagcctcagttcgtgcatccatcatagtattttttttatctaaaattatatttcttacctgttcagctatttcaataccaccaggttcacgtgttaataatactttatatccttcagattgcaatttttcaaatattatttttgaaatagtagttttaccactaccatctggtccttccaacgtaataaacttacctctcattttttacttccttccttttttatcaaagcaatctataataaattataacatatgtcatagtttgatacaattcattcatttattagtactataaaattaaaataaatattattttaatatatatttataataaatattaaataaaaaataatatttattataaatataaaataattaatattattttttataattatttcataataggcttataaaatatataataataattccaggatatcctagcataattagaataaaaatatttaaaatattaaaagtaaaataattatttgtcaatatatttaatatatacaagattataattgatttaaacaaggttaatataaattttcgcataaaaacacctctataataattatatgaggtgtttatattttctttctaccttcaagtgattttaataatgttaattcatcagcataatcaatattacttccaataggtaaaccattagctatcctacttgtatttatatttctttttgcaagtaatttagctaaatataaagcagttgtttcaccatcacgcgtaggattagttgcaataattacttctttgatagaatcatctaatcgctcaaataaagaatcaatatttaaatcatccattgttttaccgtccatgattgacattgtcccatgcaaaacatgatatactccattatattcttttattttttccattgcaaaaacatctttagattcttcaacaacgcaaatgatactttgatcacgatcatgatccatacatatatcacaaatttcgccttcacatatatgaccacattttttacaataatgtattttatcttggatatttcctattgcttttgaaaaatcattaacatagtctttttccattgataaaacataataagttaatcgttctgcacttttactaccaataccaggtaaacgcttaaaacaatcaactaaatcttgaaaagcttctggataattcatataaacctcctctattcttcaaattcaacaagatctccaaataattcaactgccattgattgtgcttcatttaattttttttgagaattttgaaaagttccgatatgatgtaaaacaattggttttgcttcaggaagagtttttgcgcgattcatttcaatatatttatttcttatatcaggccatgtactactttttactgctataaaatcataactttgtcctaatacttcttgaagaaacttttttaattgataataattttccgtttcattaatctcatttacatttggctgatgctcaaatgcaataataattcctccctgacaagctgcaacaggattaccatcatataacattgaagcaaattttgctgtattaagattgaatcgatatcttgcaattactgaccatttttcttttatttcatttaatattcttcgatcagcttgaactagaatatttaaaatatcatcaaatgaaacatcaatatttttatttgaaactttttgctctgtatcatctttgacatttttattttcttctttttttaaatcattatcttgatctattagcttggctgtttctggtgttatttcttctattttatttaatttttcagaatcatcttctttttttatttcttctactttttttgttttttcaatgaaattattttcttcttcaagaagaactttattttcatcttttacattattacatatttttaacattgctagttcaaaatatgtttttgcatctaaagattgactataatgagaacttgcttctattaaaatatcaattatcttaaatgcttcttcaattaaaatataaggtactaaattatcaatatcatctttagataatacaaataaaatatcaatatcttgagtatttttataaattattacatcttttaaaacatctattaaatcatatgtcaatcttttaatatcaatacttgtactgagcatattatctaatgattctaatattccctttaaatctttagaaagtaattttttaataaatataattttattatccatggataataaaccatatatcatattaacactttctacagttaatttattttcataagctaaacactgttccaaaatacttaaagcatctcgcattccaccttcagccaattttgcaattatttttaaagcagctacttcatactctttcttttcatgctttaaaacatattccagtctatcaataatatcactttcatcaacttttttaaaatcaaatcgttgacatctagatatgatcgttggcaaaattttatgtggttcagttgttgcgagaacaaaaacaatatgtgccggtggttcttccaaagtctttaataaagcattgaatgcccctgttgacatcatatgaacttcatcaataatatacactttatattttccatttataggtgcatattttactttatctatcaaatctcgaacttcatctacaccattattactagcagcatcaatttcaataacatcaggatgttctcctgctgttatagctttgcaattaggacaagtatcgcaaggaggattatctccagtacaatttaaagcttttgcgagtaacttagctacagtagttttaccagttcctcgtggaccagcaaataaataagcatgagaaatacgattttctttaattgcattttttaatgttgttacgacatgttcttgcccagcaacttcattgaaagtttggggtctatatgatctatataaagctttataagacatttataatcactcctcatccttatctattatactatataattaaaaagataaatataattaaaaatttaattttttattattccttttatttttaaaataatctttaattatttttgaacatttttcttgtaaaattccaccagtaatttctggtctatgattaacaggtgaatctgaattatagatagtagtcaaagccagccatcttttttcatatgccccaaaaactactttttttattctactatttattatagctccagaacacattatacacggttcaagagttacgtataatatacactcatcaagataccaagaattaaattttttacaagcttcattaattgctataacttctgcatgagctgtagccaagttagtcgtttcacgaagattatgtgcctgcgctattatctgattatctttaactataacagctccaacaggtacttcatctttatctaaacactttaatgcttcttgatatgcaatttccataaacttaatatcttgttccatgcaaaattctcctttttataaaaaagccactacacacagacggttattcttaatgctgctaccttccggtcctgacatggttcgaagccgcctattgtaatggcaaaactaattatataacattaattcatcaaattcaataataaacttaaataaaatataaacaatatttaggatattattttataaatataaattcattaaataaacattcaaatattcatcaccaattttcatataattatcataacgtccaataatttcaaatccaaattttttatacaatacaattgcagccatattatcagtaactacttctaaatctataatttctaaacccgcttcaattgcataaccaatagtggcagaaagtagatttgaaccaattccttgattccaataatcttttaatacagatattcccaaacttgcatgatgtttcaaacgttttttagaatttccttttaatgaaaccatccctacaatttgattatcatcttttgcaacgatcattatagaattaggatcatcgttaatttcttgaattaattccatttcctgaatttcatttaatttatcatcatcagctccaaaagtaagatttgttgtttgatcagcaacaatatttaaataatcaacgactcttttagcatcactaggtaaaacttcacagtattctatttccatcttttcaccccatctttatttttttaatcttattttcgttataatttgtgttgcaagatatactaataaagtaaatccacaaactattaacatatctattaaaactggtttaatagcttcaaaaccaaaatcatttaatttaacaatttcattattagcttttatgaaccagtatgaaggtaagaactttgctaaagttaatacaaacggacttaacatactttggggaacaaaagccccacatataaagcttgatcctaaaccaaaaacatttcctacaccacttaatatttcacgattacttgtaaattttgctatcataaagctcaatgcttgaataaaaagcattaaaacaagtgaattaattactaataataatccatttattgtcatcatggctttactatataaaataaaactaaatataacatataataaccaaataaataatccaactgtataatttcctagtaataattggcgattcatacttttataacttactggtgatactaagttgcgacgttttatcttttcttcattaaaagataccatgatcattgttacaataaccattgttatagttattaacatataattagaaaaattataataggtagcagcttttgtaaaatcaatatcattttgcttttccaacatgcttacttctatatttttacttaaatcttctttaattaatttagttaacttttgatcactaattcctgcttttaaatacaaattagcagtatttagatacttatttaaaagactcttactataaatactattataagaatccggcaattccattgtttcaatttgaacattcttaccactaataaaatcagatgtataatttttaggtataatcataatataatctacagttcgataaaacaaagcatcacgtaatttttcttcttgatcatctaaattaattaatttaccagaatcttggatatattcttttaatccttcaattagattagtatcttcatctcgattaataacagcaactttaacatctacccgtttatattcagttgtactagaattatatgtccctgcaaatattgctaatccaagaaatatagctgtatatataattattagtaaagtataagtattagcaacttttaaatattttttaaatactgtcatattgcttcctccttgtgaagaataatgatcctgcaattagaagaacaccaattataaatagatagatcatatttgttgtataacgatttaaactatcataatagtaaagagcatataatccatcagttattagattgacaggattgatatatgctaatattggtaaattggtttgcatccaatatttaatatcgataatcatcattcccgaaaagaacgatagtactaatgaaaaacttgttaaaaaagatatttttgtatcttcttttttaaatttcaaaacatttccaacaaaatttcctaatcccacaccagtaaaacatccgatagcaattaaaataataatataaactgtttgattgccaaaaccaacatctaatccaaatatcagataagccatcaaaatcatcataattgcaaactgaataatgaaagctgataaaattcctgataaaacagtaactatttttgaaataggtgaaactcctattcttgttccctgtcttgaaagattggcttcaatctgactcgttgttcgaagaccacaaaaactggcatttaagcaattcattccaattaaagtataaaaatatacaacggttaaatctgtattaccaccaatattcaatgttttaaaattatccttagataaattaatagcatctaaaatattagtttgtaaaatgtcaggacttaaatcagtaatattcttaattgtactcattgtactattatactcatttgcaatactttcaagaattgtctcatcaattccagtatcatttactactaattcaattttatcacttacaagataataacctttaattttctcatcttttaataattgttttgcttcgttcaaatttttaacttttaaattaattagtttttcattaccattttctaatgattctaatgtttgtttaaaatatgaattttcttgtttttcaacaagagcaacattaattgtttcaaatttttcactagctgttaaattagaaaatgctaaattaaaaaaagtagcaagagcaagtggaaatattaacgtccaaaatattaccattttatttctaattaatgttttaaattgatatttgaaaaagtgaaaaaacattaatctcttaactcttttcctgttagttctagaaaaacatcatttaatgttggacgttcactaaatatactcgtataactaacattattttcacgaacataatcaattaatttacttaaattatcttctttcgttttataagaaatatgaactatattattttcaatttcaatattaattactcgcttactatttttcaaacgatcaataaaagcttgattcattgattttaattcaaccgtaattttctcacctaaactgatcatatccttcaattcatcttttgttcctgaagcaattattttacccttatccataataacaattcgattacatagctgctctacttcttccatataatgagtagtatagacaattgtagctcctaattcatttaatttttttattccctcaagaatattatttctactttgaggatctactgctacagttggctcatctaaaaaaattaattttggtttatgagctattccacaagcaatatttaatcttcttaataatcctccacttaattgcttaggtttaaattttttaaattcattcaaacctactaaatctatagcatcttgaacataattatttctaatttttttatctttaatataaagtccacaaaaataatcaatattttcaattacacttaactcttcaaatactgcaacatcttgaaaaacaactcctattttgcttttaatatcataggcagttggactcatctcttgattaaaaatacaaattttaccagaatcatactttaataatgataaaatagtatttatagtagtagacttaccactaccattaggtcctaataaacctaaaatttcaccttcataaacatctaaactaaaatcatctaaagctactagatcaccatatcttttagttagatttttaatttctatgatcttttccatattatcttctccttttatgtcacggtagtgtcaaaaaacagttagttttttatatgtctttttaactgtaaaacctcattctaccttggttttttatatattctgattaatttcccccgaaattaatctataaacttaaccatttcctctatacaaaaatggtaactacatcctataatgaagtcaccacaacaatcacaaaggagtgtaattaccatggttaagattatatcatttattatttctttattaaatatctttcgtaaacttttatataaatttgaatgctttcttcttcagttccttcctaacgatcctaatcctaatccggttagtgatgcctacagaagattcaaggttcatcctttacctgttatcgaacctgaacatcttcctgtctctttcgatgaagccagggctgcttatgaagctaaacacaacaaacctttaaagccggtttttagacataaaggtactgtctgccctcattgcggtgccactcatgaatacctttcttttaataatggtcaaaagaaatctcaaattaaatgtaaagtatgcgaaaagaccttctctactgaaaaatcctattctcagcaggttgttagaaaatgtcctttctgtggtaaaaaactgactcttatcaaatccagaagcagttttgacatttataaatgcatgagtcccaaatgttcacactatagagctgaactgaaaaagctttccaaagaggacaggaagaattacaaacagactccttctgctttctctcttcattacatcactcgtgttttcaatgcttctttagacagacttgaaagcattcagcttaaaattgagccctcaaagatcgatttgacacgcatacgcaattctaagcatgttttagggcttgccctgacttattatgtcaattacggcctttcattgagaaaaactgctcttattctccatgaagtccatgatatcaagatatctcatcagacaattgccaattatgcccaggctgcaagtcatcttctttttccctggatggatagctttaagcatgacctcaatccttatcaatgcggtgatgaaacttatgtgaaagttttaggcaaaaaagcctatgttttcttcatgtgtgatgtcagaaagaaaatcatcacttcatataggatatacatgaaacgtgatactttcagtgcaatcgatgctttctattctgttttaagaaaattcaaggaaatccctgaaatgttattcggtggattattttaattaaaataacagctatttagtcaaacaaaaataataaacatagaaaaatagttaaaataatttgataaaatgataggcaaattattttaactattttattattatataaaggagctgacatacaaaaaaagaaagggtcattggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcgctgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaatagtgaaaaaatagcctgttatatgaacagtattattgatggattgacgatagcaaaaggattaagtataataagcgctcatatagcacaataccaggcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacactgaaaatctcgaattcgttgtagatggcaatcctatatataaagcagctcagcaatattttcagctcaaacgtgttttctttaaagttacacaggttattggtcttacgaatgatgatccagtatcaaaggaacatcgtcctgccaaacagatcatagaacgtttaaatcgaacatttcaatattcatatgccgtcaagaacggtttcaacacgtttgcaggtgccaatgacttcatgtgtctgtttacaacatactttaactttttaaggaaccatacagctctaggatataaaccgcctgtacagcttgactgtttaaaaaagacacataatatgccaagtaagtggaacatattgcttgatgaagccttgaattattacatagaatcgactatggaattctagttatgaaaaaatttcattttttcataacttatttgacactacctatgtcaccactatacataaatttatcacaagcagccaccaactttagattgcagattattattttttagcaactattagttgctaactacggtagcgttttattttttcatttatcttacgagcatcatcactattttttatatatactatcccactacaaataaaataaataattgtagatataattagaataataatgctatttataatacttactgtaaatccgtataaataattaataatgattattgttcctgctatttcaataattgaaatcaaatcagatatccattctttaatatctaaataatgtgtcacattaacaaataagttaatcaaaacacaaattttaaatatatcaataatatacttgttgtttaaataaattccacctaaaactgtctgtactagaattactaaagtaaatgaaatacaagttgtgataaaccaaattcttattttcttcataaaattatcacctacattccaaatttctttttaaaatcacttacataatgtcgtgttataactaatttttcatcgtttattaacatcgcctcataacgaccatttaatagtgctttaacattatctaatttatttaaattcaataaaatagatttactgatacgtataaaggaacaagtttctaattcattttccaattcatataatcttgaatttgtttcgtaaactttatctttgcagtaaagaaaaactcgatcttcattagcttcaatataataaatatcatttaccataatttgataactacgattatttaactttccaataataaatttattatcttctagtaaagaaatgattttcttgatattatcatcaactttattacatcgaataactatttctaattcactatcttccctacattcaataacgatcttcatctaactcctcctttataaaattagtgtatcatattattatctttttacctatcatatttaagtaagatacactttgtcccaatgaaatgcaaaaaaagtcaataacactttaatatttaaatcaactacaataataaaaagtacatcttttatcattattagatgtactttttattctgatatttaatttatattattaatctctatgatagtgttcatttaaccaacgtgccacaccatcttcatcattgcttaaaattatatctgtagcacagtgctttaatttttcaactgcattgcttactgcataacattgatcagatattgcaaacattggtaaatcattaattgcatcaccaaatgatattacttcatcacattttaaaatattttttaattttaaaattgcacttgctttagaggcactttgaggcataatttctaaccagtattcttcacgatatatttcttgttgaaatgtaatattataataatcatatctttttaatttttcatatattggttttaaatctttatattcaccaataacagtaaaataaaagatttcgccttgatataaactattataatcatctgtcaaattgattcgataatcattttgacgattcttcaaatagtgtttagttccttcatgtaagtcattattaatgatcgtaactctttctctatcatttattaatgcataaaccattggtcttacttgattagattccattatttctttgactaattctatctgatttttattaaaaacattcttatgaataattttaccagtctcactattaactataaatgttccattataaataattaatggtaattttttagtcagacctttagttactggagctgctgaaactaacgatcttgctgttgcatatgtaaaaatcatacctttagaaatcaaattatttattgtttcaacactatagttacttattcttccattactatttaataaagtgccatctaaatcactaacatataactttttcatatagataaaaagataactatttagttatcttttcttttcctcccatgtatggctgtaatgctttgggaatattaacactaccatcttcattcaaattattttcaagaaaagcaattaacattctaggtggagctacaactgtattatttaatgtatgtgcaaaatatttacctttttcaccatttatacgaatatttaatcttctagcttgagcgtctgttaaatttgaacatgatccaacttcaaagtacttcttttgtcttggtgaccaagcttcaacatctatactcttagattttaaatctgccaaatcaccagaacagcattctaaagttcttactggaatatctaatgctctaaataaatcaacagtattattccataatttatcaaaccacattttactatcttctggtttacatacaacgatcatttcttgtttttcgaattgatgaattcgataaacaccacgttcttcaataccatgagcacccttttcttttctaaaacatggtgaatatgaagtatatgtgtaaggcaatttatcttcatctaagatattatcaataaattttccaatcattgaatgttcagatgtcccaatcaaatataagtcttccccttcaatcttatacatcatactgtccatctcttcaaaactcattactccagtaacaacattactacgaatcatgtatggtggaataacataagtaaaaccgcgatcaatcataaaatcacgtgcgtatgataaaattgctgaatgcaaacgggcaatatctcccattaaataataaaatccctgaccagcaacacgtccagcactatccatatcaataccttcaaatttttccattatttctgtatgataaggaatttcatattctggtactattggatctccatacttagtaatttctacattttcactatcatcttttcctaaaggcacagattcatcaatgaaattaggaattttcatcataatagcctttaactcactaccatattttacttctaattcttctaattgctttaactcttcagccatttcattaacttgtcttttattattttctgcagcttctttatttccttcacgcataaattgaccaatttcttttgacaatttattacgcattgctcttaattcactagcttttgttaaaacttctcgataatctttatctaatttgtaagcttcatctactaatccaatcttttcatcttgaaatttctttttcatattttcttttactaaggttggattttctcttaatattgcaatatcaatcattctaattctcccttgcttatatttttttaaattatacaataattattcatcttattcaattattatcaaaatgtttataatttatttcctcggcaataaatcacctcatttaaaccatatcatataacttatcgatatttaactgataatgcttttctctagaaatttttgtttcaatcaataaatctttcaaactagaatttttaatatctttaattttattaatgatcgtagttctagataaattagtaatattcattaaatcataataacttaatccttcattatcaaataatgtacactgtaaaaatacatttaataaatgatatacatcttctttatcacaaatttcttttaacatttttttatttaaattgtactgttctaatttatcacttacaatttctaaaagattttcaagtcctgttactattatttctaaaaatataataacaaaacctgtaagatcagctttatttcttacatcatttgtaaatttaaaagcacgataataatcattttttctctctttacaactaatcgataactgcaaagcacataaaatatcaagttcatcatttaaatataaacttgatatatatctgctcattcttccattaccatcataaaatgggtgaatatatccaaataaatagtgaaatacagctattctaataaaaatattaattgcctgatcatttaatatttttaatccttcattcatataatttattatttcaatctctggcataattcctttatgaaaagctccatcatattcactaataacttcaactgcttcttttctaaatatttcaccatctggctgattatcagaactttcattaatgacatcaactaacattatttcatcatacaattttctaatactatcacatgtcgtaaattttaagtattcattattaattaaactattatatttatttaccaaaccataaaagcgactcttcttttttttaagtttttattaattacatcttcatatacttcttttagttcttttttagtactatgaattccttcaatttcatttgtcttaataatttcttctattagagtactttttataaaatattgtcttgcaatacatggtaaatcattatacttttcaattattttattatttaaatgatatatttgagagactaattgtaatatttcatgattaacaatcataaatgcaggatttttatttattgtgatattaaaatttattgctgtttcattattaatcttattttgatatatttttttaaattcagatgaatttgtataatgatattgtttttctaaagttttgtatatcataaaaaacctcccatctataattattatatatatttaaactaattatacttacatatgtataaattttttaataattttacagataatatatcattagtgtatttaattatcaaattttactaattatttttaattaaaaaaggattgtaaatataaatagatagatttatctattcaattacattccttttttacaactatttatcatctgtagctttttcaacaacttctactgacgaaactttattttctggattaactttgatcaatcttaccccttgagtagctcgaccagcagtttttacttgttccattggtagacgaatcataattccatcatcagtaataattaataaatcttcatcaccattaacagcccgcaaagcaacgatttgaccattacgttcagtagcattgatggttttaacaccttttccaccacgattagataaacgatattcctctaacggtgacatcttaccataaccgcgttctgtgacaaccataataaattttccttccttatcagttgtcattccaataacttcactaccatcaacattaataccctttacaccactggcactacgtcccattggtcgaacattagtttcttcaaaacgcactaattttccatttgatgcagcaactaaaatttgatcatttccactcgttaatttaacctgaaccaattgatcatcttcttttaagttaattgcaatcttaccagattgacgaattctttcaaattcatttattggtactctttttactagtccatttttagttgcaaagaataaataacgatcactattttcttgaatatctttacgattgatactgatcatagatttaatgctttcacctttatctaagttcagcaaatttactactggcaaaccttttgctgctcgaccaaattcaggtatgttataaccttttaaacgataaactttaccaaaattagtaaagaacaaaagatcatcatgagtcgacatgttgattaatgaagtaacaatatcatcactatttgttgacatgcctttaattcctcgaccaccacgattttgactcttatatgtatctactggcattctcttgacataaccattatttgtaagtgaaataattacatcttctacaggaatcaaatcttcatcttccaaatcaaaagttccttgaataatttcagtacgtcttttatctccatatttatcttttatttcttctaattcatcatggataattgataataaacgctccctattttcaagaatatcctttaaatcagcaataatttctaacaatttattcaaatcatcttcaatcttttgtctttctaaaccagctagacgctgtaactgcatttccctaattgctttagcctgtttatcagacatattaaattcttccattaatcttgtttgaataatttcagtagtacgacttgacctaatcaaatcaatgattgcatcgatttgatctaaagcccttttcaatccttctaagatatgagctcgatcttcagctttagctaatctaaactttgttcttctcctgattacttcttcttgatgttcaagatataaagtaatcatttcttttaaatttaatgtttttggttcattatttactaaagctatacaattagcaccaaaagttgtttgcaaagatgttaatttataaagttgatttaaaataacttctggttgaatatcacgacgcaattcaataactacacgaattccatcacgatttgattcatcacgaatttctgtaataccttctattttcttttctcgaaccaattgtgacatcttttcaatcatccgagctttatttaccatataaggaatctcagtaacaacaattactttcttactccctttatcttcaatttctgttttagctcgcatcacaattaaaccattaccagtttcataagctttttttatagcactttttcctaaaatatatccaccggtaggaaaatcaggtccttgaatataattttccattaattctacaattgtaatatcgggattcttagctactaccaagattgcatcgataacctcagataaattatgaggaggaatattagttgccattcctactgcaattcccgttgatccattaattaataaattaggtatacgcgctggcagtacagctggttcttgttcttctccatcataattaggaacaaaatcaattgtatcttcttttaaatcacgtactaattcgctagatatcttcgacattctagcttcagtataacgttgcgctgctgccccatcaccatcgatagaaccaaaatttccatgaccgtcaacaagcatataacgatatgaaaaatcttgagccattctaactaatgcttcgtaaatagaagaatctccatgaggatgatatttccccattacttctccgacaatacgagcagattttttataaggtgttccaggtgtacatcctagatcactcattccataaattattcgtcgctgaactggttttaatccatcacgaacatccggtaaagctcttgatacaattactgacattgcatattgcataaaagagtttttcatttccgatgttaattttacttttctaatcccgcgttcttccatcatttatctcctttattaaatatctagatcagtaacatatttagcattttcttgaataaattcacgtctaggttctactttttcacccattaacatatcaaagatcatatccgcttccattgcttcatctaaatcaatttgatttaaaattcgcttttcaggatccatagtagtttcccaaagttgttctgcattcatttctccaagacctttgtaacgttgaatactatattttgccccatcacctatttttgtttttaaatcctctaattcttcatcgctataacaataatgttcatctttaccatgttttaataaataaagtggcggttgggctgcgtaaacaaaaccattttcaatcaatggttttaaataacgatataagaacgttaacattaaaatcctaatatgaccaccatcaacatcggcgtcggtcatgataactattttatgatatcttaatttgtccaaattgaattcttcgccaattcccgtaccaaatgctgtaatcattgatctaatttctgcatttcctaagattttttcaagcctagatttttcaacatttaaaattttaccacgcaatggcaaaattgcttgaatccgtcgatctcgacccatctttgcacttcctccggcagaatccccttcgacgataaaaatctcacattcactagcatctttacttgaacaatctgctaatttcccaggcaaattagaaacttcaagaacattttttcttcttgtcatctccctcgcttttttagctgctaatcttgctctagatgcaacgattgctttatcaataattatttttgcggtatctggattttctaataaaaatttatctaatgaagcactaataatattacttgaaatttttcgaacctcagcattccctaattttgtttttgtttgtccttcatactgaggatcaggatgtttaacagaaataattgctgttaaaccttcacgaacatcatcacctgataaagcttcttcatctttttttaagacacctttattttttgcataattattaataactcttgttaaagctaagcgaaatccttcttcatgagttcccccttcatgagtattaatattattacaaaatgaataaatatttgattgatagccatcattatattgcattgctacttcaattgtaatatcctgctgaacatcttcaacataaataacttcttcatgaattggggttttattcttattaatataagcgacatattctttgattccaccttcaaagtagtattcatgtttatgatcagctccattacgattatcttctaatgataagcgtaatcctttatttaaaaaggctaattctctaattctttgtcttaatgtatcataatcataaactgtgccttctttaaaaattaatttatcagccttaaaagttactactgttccggtaatttcagactcaccaataatttttaattcatctactggtttaccaccattttcaaagcgctgaaaataaatatgtccatcacgatagaccttaacttcaagccattgtgataaagcatttacaactgatgcaccaactccatgaagtcctccagacactttataaccaccgccaccaaattttcctccagcatgtagtacagtaaaaattgtctcaacagttgaaattcctgttttagcgtgagttccggttggcattcctcgtccatcatcaataacctgaacaacatcatcatcttttaaaattactctaatatgacttgcatagccagctaaggcttcatcaattgaattatcaacgatttcccaaaccaaatggtgtaatcctctaattgaagttgtcccaatatacattcctggtcttttacgaactgcctcgagcccttctaaaacctgaatatcggattcatcgtaactatgttctactttttcttctgacatcatgtagcctccttgccactttcaatataaattttcttagctttttctacaatttgatggttgataccatctatagaagtagttgtaataaaagtttgaattttttgattcaaaatatctaataacatatttttccttgtttgatctaattctgataaaacatcatctaataataaaattggatactcaccaatttcatctttaattaaatcaatcaaagcaatttttaaactcaaaacaattgttctttgctgaccctgcgaagcaaaaagatcagcaagattttcattcatatatatttttaaatcatctttatgtattcctaaatgacttttcatatactggacatcacgatggtgattttttttataaagagataaaatattttcatatgttaatttttctttaataaaacaactataccgtagtcttattttttcactttcccttttagcaattttttgataaattaaattaactttattatctaattttttaataaaatcaagacgctttttaattaactcaacttgtaacttagctaattgctcatcaagaacttcaagatattcatcacaatcttgatttctttgatttaaaactttcaaatacttatttctttctttaagcaatccattatacttacttaaattaaagacatagatcggtgatattttagaaatctctaaatcaataaaccgacgacgattactaggactacctttaattaaataaagatcatcaggagtaaaaactacgacatttaaaagaccaacatattcacttatcttataaatatcctggtcatctattttagctcttttaaaatcatttcctaaaactatttctaaattacgtttcttgttattagaaatgatctcacctttaactttcgcaaaatcacaatcaaacataatcatctgcttattaatatgtgttttaaatgacttacctacagaaagtaaataaatagcctctattaaattagtctttccctgtccattactgccaattaaaatattaatatcctgattaaaatcaataacaaattgcttataattgcgaaaattagttaaacataacgatttaattatcattaaccaataacaaatgtttctccatcaaattcaattgtatcatcagttcgtaatttcttacctcttctagtctctatttcaccattaactaaaactaatccatctttaataacaatttttgcatcaataccacttgatacacatcctgaaaattttaaaaattgtcccaaagttatatattcatctcttatttgaattattttcataattaccctctttttttataaaattctagcaacattataacataaaatatattaaaattcaaaaaaataagcattttaacgctttttttaataaaaagtaaaaaaagttatttttaactaaattttgctcatatttaaaatttatccacgtataattaatatgcccagtaaaaaaacactttcacgaaaaaaagctacagtatgtagctttagaaagttcttacaggtaaaaccagttgaataacatcatctttttcataatctttaataataaaaggtttcatttctccagtaaacaatatctttattttaggatcattaaaagctttaatcgcatcatttgcatattttgaactaaatgagatacttaaaggttcccctttataaaaagctttatctaatatttcttcaacagaaccaatttcttgcatataagaagataaaactattttatcaggatccatatctaatttaatgatattattttgctcatttgtaagtaatgaaacacgatcaatagcattcaataagtaatgagtatctaaatctaattcataatcaaaactattaggaattaaacgattcgtatcaggaaagctgccatcgatcaatctagtttgaataatattattatcaaaaacatatagtactttgcggtcagatacgtacatttcaattagttcatctttttcaattatttttgatatttcatctaaagatttctgaggaatagtaatattaaatgttacgctttcatctaaactaacaatttttttagctaaacgataactatcagtagctgtacattctaattgattattggcagctttaaaatttattcccgttaagattggcttatgttctttatcactagctgcaaatttagtttgagaaataatatcttttaaagttaatgaattcaaaagtattttagtacctgttttagataaatctattcgtggataatctaaaacatcagtaccatttaaatcaaattttgaatttgaacctgaaattcttgttaaagcaccatcgattatttgaattgttatatcatcactatctatttttctaacaatatctaaaatataacgtgaattaagaactactcctcctgtttgataaataattaaatcatcatctttttcaatcttagtttgaatcgtaatatcagaatcacttcctgtcaaaattaaactatcttcatgtagatcaaatttaattccagtaagtacaggtaaaggactacgaatagaaacagctttagtagctttagaaagagcatttaataatttaagtctttttattttaaaattcataaattttttctccttttaatatttatatatattttttttaaattttattattactattatcttgtgaataatgtgcataagttataaaagtattgatataatcagtgttttttatgtgcataacaatgtgttttaattgtggcagtaatgtgtttaatttacatttaatttttcttttaacttatttatagctaatttgtaatcagtatctttctttattttagtttctacacgggcacaagctttcataactgttgagtgatcacgattactaaatgtcataccaatttctgcaaatgtgatatctaataattcacgcattagatacatgcacatttctctaggtgtagttaattttctagttttatttttagagattaattgacttatcgttaaataataaaattctgctgttgtttttaagattagttccttagttaaagcacttttaggattcttaactactttatcatccttaaaagattcaagtgcaaaagacatatcgatagtatttgtatggttcataatactgcaaaagaataaacgttttaacgctccttcgagactgcgaatgtctttacaataatgattggccatgaaatcaacaacatcatcttgaataactagagatgggttatcaagattttcaattttcttttctaaaatagctcgtgccgtctcaaattccggtggatcgattccaaaacttaaaccagaattaaaacgacttattaaacgtgattcaataccttggagttcttcaggcattttatcactggtaataacaatttgtttattgttattaattatttcattaaaaatatgaaagaacatttcgctacttttttctttattgaagagaaattgaatatcatcaattaacaaaatatctaatgtcttatatttagcatagatttcatcgccatctttacttttcattgcgccaattacttcatcaacaaaatctttacttgtaatataacggatttttagaccaggatttatctctttagcataattaccaattgcattcaataaatgagtcttacctagaccaggattactataaatgaataaaggattaaaatttgatcctggattagttgatacaagcaaagctgcattttgtgccattctattggatccgccgacaacgaaattatcaaatgttaaagttcgattaagattgtctttaaatgtttcttttttttcttgagtgatcgattttttaaattcatcttcaccgattatttctacagttactggtgatgctagcatacctgaaagaatatcttcaatatcttttaaattattctttatagtttctacattaaaagaataaggtgtcgtaatagtaaccttattattattgatagaagcaatttgagcatttctaaaaacagattccatgattactttatcaatttttcgctcttcaggtaaattttgtctttcaagagtatcaagacataattgccaaattttactattatcacgcattattttcacctccgcatcataattataagcaaataaattgtaaaattaaagaacaaaaaagaggctaaatttctattcacaaagttattcacaataattgttatatttattaaggtttttctaacttattcacattattcacaactttatttgtgcataataaatgatgtgaatgtgaaaattgtgatgaaattagtagataaaaatgataatgcactaaatattcacaagtaaaacataatattgacaatatttttaccagtttttcacatttattcacattcaaaatcacactgaacaaattatgtgcataaaatatgtatttctgtgcataatctaaaaattactatcaaagaatgtcacaattaaccattgtaatatgagttaattatttttttatttatagataaaaataaattaaaaaaatagtattattttactaataattataaaattttactaattatttggtgttataatataataaaatagtttaaataaataaaaattataattaaactgaattattttaattaaatattatagttatagctataagtgtataaggaagaaggtggtgtattatttgtatttacaaatttaaataattcagttttttataaatataattatgataaaaatataaagtttaaaacgatagaagggaaagatatgaagatattaaaaaaaatagttaaaagtttgatagtcattacaatgattatcgggtatttagctattgatgttaaagctattgaaaatagcgatggtttatcaaacgtagctttaaataaattaactattgcaagtaatggaaattcatctcgagcagtagatggtgataagactacttattgggacggtagtttatatccaagtgaattattagttgatttagatgggtattttgatgtttcaaaaataatagttatcccatattataatggaagccgttattataattatgaagtttatacaagcgttgatggttttaattatgaaaaagtaggagaaaaaaccgataatactttacaaacagaaaatggggaaacttatttatttgaaactaaagttgcaaaatatgttaaagttaaaatgacgtataattcagctaatactagtgtgcatataaatgaattagaggtttatggaatagaaaatcctgactatgaagtacctgatatgccaggtgtaggtcctaatgatcctgataatattgcatatggtaaacctactagatcaactactaatagtaatttttcatcattagttgtagatggacaaagatcgacttcatggattggtgaggattatcctaaatatgtagatgttgatttattagaaaattatgatatatcaaaaattaaggtttatatgcctcaaggtaatgttaaatttgcttattcattgtatggcagtttagatggcgttcattttgaacgaattgctaaaacagaacttaaagaaagtaatgaaaatggtgatgaatttattcttgatagtaataatacatatcgtgttatacgagtaaatgttacagcaaattcaaatggagaaggggcaaactcacaaatttcagaaataaaagtttatggaattaaaagtgatgttgaaaaaattgaaacacgcacagatttaaatatagaatcgtatgatgactggctattagaaaattatcatgttgatactaaagctattagtgatgaaaatggtaaatataatatagctgatacttttaatgatgctgatgtatttgcagaggttagtggtgttattacaagaatattaggtgaaaagtataatgattggtttacttttgaattagcagaaaatgattctggcaaagattattatgaactatcttctttagatggaaaaattcatattaaaggtaatgaaggtttatccctaactacaggattaaattattttttgaaatattattgtaacgttcatatttcacagcaaactaaacaagtaaaaatgccggatactattcccgtattaaatgaagttatctacaaagaatcaccttatgaaatacgttatgcttataattattgtacgttatcctatacaatgctattttggggatacgatgaatggcaaagagaattagattattttgcattaaatggggttaatttgattttggatactactgctactgaagcactatggatagagtatttacaaaattatggttatgatatcgaagaagcaaaatcattcgtatgtggttattcctataaagcctggtggttaatgggaaatttagaatcttatggcggaccagttagtgacgaatgggttattgatacagttgaaatggcaagaactaatcaacgtaaaatggctgttttaggtatgaagccttgtttacaaggttttatgggagcaatgccagaacattttggtgatattgctaatgaaacgctaatggaagattatggttatgaagatattgatccatatatggttgaacaaggtgattggtcaggatttacacgtcctccaatattaaaaacgacttatgatggctatgatgatttagctcagaaattttatgatacacaagaatatatttatggacaaattacaaatttttatgctggtgatttagctcatgaaggtgggattattcctcctgatctaagtaaaccgcaaatgtcagcgcatattttagatcaaatgatggaatatgatgaaaatgctgtatgggtaattcaatcatggttatctaatcctaatcctgaaattttagaaggctttggtgaaaataaagaagatcatgttcttgttttagatttagatgctacagaaaatcctcattggagtaatactacaaattggaatggtaaagagtttggtggaacatcatgggtattttgtatgttggataactatggtggaagaacaggaatgcatggtgaattagaatatttagcaactcagattacaaaagcaaatagtgaatcaaagcatatgaaaggaattggaatcacaccagagggaactcttttaaatccagtcaattatgatttattttgggaaatggcttgggaaagtgaagctaaagatactgaggcatggttaaaagaatatattactagacgttatggcgaatattctcaaaatgcttgggaagcatggaaaatcttattatctactgcttatggtgctaataatgaagacggtagtgcaaaatatcatactggtaatgtaaattgtattactaatatgcgtccatcatttaatccagagattgtaataggagattataaattaacatatgatcctacaaaatttgaaaaagcaactgatttattaatgaaagattttgataaatttaaagataatgaatgttatgtttatgatgtagttgatattttaagacagactgttgccaatagccaagtagaattttttgaacgtataaatgaggcatataatagtaaaaattatgaaatctttacaaaatataaagataagttattaaatagtattttgcttatagatgaaatagcaggttttgaaaaagattcgttatatggtacatggatatcaaaagctactaatttttatagtgattcacgaaatagtagtacatatgatgattattcaaaggatatgatgataattaatgctaaagctattgtaagtatttggagctctaagacattacaaacatatgcacatcgacaatataatggtttagaacaagattatagttatgaaatgtggaaattatggttagatcgattagaagatgcaatgcaaacaggtaattttattgctccatcaagtaatcaggactattttaacattggttgggatgttgtaactaatgatgttaattattctacgacagtaaaagctgctgatggtaatcaagaatatcgaggattaaatgaaatatatttagaaatatgtgatggttatttaactggacaagctcaaaaagataaaatcgtggatgaaaatattgctttagaaggaactgcttatgcagatacaactctaggaagctatgctgcaagtcgtattaatgataataatgctggatcaatgtggattgctcaaacttcagcaactccagtaagtgcaggaattaaatttaatcaagaatattcaatttatggattacagttaatttttgaaacacgtccagtattaggaaataatataatgaaattttatattgaaactaaaaataatgatgcagactgggaaaaaatttatagtggtcaaagttataatgaggaagataaatcatatacaataaatattccattagatgaagctaaattagttaatgatgtaaaaattacttttgagactaatggtggaatttatccagcattatgtgaaatgaaaatttattcaagtaaaggaatccagctaatagatggaacatcaatgtttattgaaaataagattataaatggggttcaagatggaattacagtagatgaattgttatcatttttatatgctggaagtggcgaattacaatgtgttgaagatgaaaatgttttatcaggcgatacaattgttaatgataaaacaacaattcaattagttaatgatggtaaagtcattgatgagcttcaaatatcatttgcaagtaatttaattaatcagttaaatgatttagttgatgaagcaatgtcattagatgaaaataattattctaaattaagttataatgttctatttaaagctattgataatgcccaaattattataaatgatgtaaatagtaatagtagtgattataaaaatgcaattgatacattaaaaaatgcagttaataatttagtagacatcagtaagttaaaaaatgatatagataatttagcaaatgaagataaaaatgaatatatatctgaatattttgctaaatatcaatattattatcaacaagctaaagatatctttgaaaatattgaaactgctacaaatgataaaatatatcaggcagaaggctatttagaattagctaaaaattatcttattcatgaagataatacgaatgttgctttgttaggaacaccatatgcagataatgaattaatgagttcttattcaaaagaaaagataaataatggtaattttgaagattgctgggttgcaaattcaagaactaatttaccagtatctggaggagtaacattagataaaagttattctataaattatataaaagttgcttttgaagaaaatggctatcgtaatacacaattaggattcgatgttttagtacaaaaagaaaatggtgattgggaaaaagtttatacaaattccactggatcaaaaaatggttatacatttattatcaatatgaatgatcaaataattaaagatgttaaagtaacaattaattcatattctaccgatgctggttctccatatccaggaatatcagaaattgaagtatatcaaacaagcgataattcaaatttaaaagatactttaaatttagtaaaagaaaaaataaaagcaggctatgatgaaaataatactacagttacaagctggatagaatttaaagaagtatatgataaagcccagattatttgtaaaaaagatacttataatcaagaaataattgatgaaattaatacaaaattaaatgaaactgctgataaattaacattaagaggtaatatcgctgaacttgttagattagtagaagaatgtgtaaaaattgatgaaaaattatatacagaaacatcatggaaaatttttgatgagcaattaataaatgcaaaacaaattattttagataatagtgattctagtcaaacagatgtagataatgtttttaatttattacaagatgctaaagatagtttagtaaaaattgctaatgatagagataaaaaagcattagctatagctattgatatggcagaagctgcagatttagaaaatgtcgtaccagctgtagtaactgaattcaatgaagcattagaaaatgctaaagcagtatacagtaatgaaaaagctactcaagaagaagtaaataatgcttttgatcgactagcaaatgcaatgcagatgttagaattctacaaaggtgataagagtgcattacaaaaacaagtagatcaaatcaatggattagatgaaagcaaatacattgaatcaacatggtctgatatgttaccagcattagataaagcaaatgttgtattagcagatgttaatgcaatgcaagatgaagttgatgaagtatttacagagttagtaaaagctttcttagatttaagattaaaaccgaataaagacttattacaagaattgatcaataaagcaaatagcttaaatgtggcaaactatagtattgaatcatgggcaatagtagtagatgctttaaatgaagcaaaagcagtattagaagatccagaagcaacacaagaagaagtagataatgtaacaaatgtcttaggtatgaaaatagatgaattaatagttaatacagtagatacaagtaaagttgtaattccagtagaatcaagtgatacaacagcaatagatactggtgataataacctaatttgtttatttgcaggacttggcttattaagcatgtttaccattttatctggacataaaagaaaagaagattaagtgtgaaaaataattgaacccaatcgtgagtaaaaacacaaaaaaagacgaacttaaaaacaagttcagttttatttagaaaaaacagaatattatttaggaatatcttgaattgttgatacatcaaatccctgtgattttagaaaatcaagtgctgtctcaactgtataattgttcttttctttttgtggctttggattcttaaatgattcatagtctgaaggattgaacttttctccagtaagaatcatatgataaatactgacaagcatcatccttgcaatagctatgattgctttcttgtgtcctcttcttttcttgatttttgtatatttttgaccaaaataactgtttttgtttttgatagctgccaatgcacattgtactaatactggtttaagatattgtccagctttgttgatacgaactgatttcttctttcctgcactttcattattggcaggagaaagtccagcccagcagcatagttgcttatctgtttcaaattgagtcatatcaacgccaatttcagaaatgataagaatggcagacataagctgtattccatctatttctgtaatatgtaaaaaatcatcaaagtatctggaagcacgtttgatgatttctacttcaacagcttcaatatgttgattaagttcattcatatgtgattgaatttctgccattttaaatctttgatctggctcaatttttgaacttttaagagattcaactattttatctttgtttttgcacttaccatgaataagttttgtgattttatcttcatcaataacttcagtagatagaacttcattcatgacggcctgggctgtttttccaaaagtatcagaaacaacagaagccaaaccaatattggaaacagtcatggagttctgataacggttacgttcactagttctcatacagatgagcttaaaacgataacgagagagatcccttaattcacgaatatccttaggcgggataaaagaagatttgagaagatcatgcttgaaaagatcacaaatccatttggaatctttcttgtctgttttcttgcccttgatagctttgacatatttaggatggacaagaacaatattcattttagcttcagtctcaaggacattaaagacagggaaccaatacttaccagtggattccatgcagacatcaaaacattcgtgttcaataagccagtttttaagattatagaggtcaaagttaagagaagagaaatctttctgaatatattcagtgacatgagttttcttgtcagtgataccaatggtagcgacgataaggttcttgtgaacatcaagaccagcacaattaaaacggtggattttaagcataaaaaaactcctttcaaaaaaggagaagtggcattgactgtcagtctgcaaaatatcactatagttgataaaaacaatcttaagtgtccaggctctaagtcctacttgtttgtgcttgaaagactgacggcgacttataattattcaggatattctatatagagtagaattgcctactctcctccacgtgctctgtagtataccacctctcttataggatactacaaaaacgattggatgagaattatttttaataaaatgtttgtgtctgaccgacgaaggcggacggaaatggagggaattatgtaaaaaaataaattaatatttgattgattctacttttacaggatctttggtgtaaaaattatctatgttaaaaaatgaaaaagcataacaaacttgataaaagtgttatgctttttttaaattctattatttaaattataaatagtaactgttagttttatctaaatttactttttccttgaatttcattgacttaaagaggtttttcatataaaatgggggagcatatgttatttgtataaaaagtataaaaattttggaggtgtaattaatgaaaagaacatatcaaccaaataaaagaaaaagatcaaaaactcatggttttagagctagaatggctactgtaggaggaagaaaagtacttgcacgtcgccgtaaaagaggaagaaaagtcttatctgcttaagaaaaatccactttacggtgggttttttttctaaaaattatgaaaaaagattatcgagttaaaaaaaatgaagattttagttatattattaagaagaaacaaagtatagctaatcgatctttcattatttattatttaaaaaatgatgtaggtcatgcacgtgttggaatatctgtgagtaaaaaattaggtaaagcagtagttagaaataaaattaaacgacaagttagaatgattgttcaacaaactataaattttaatgatagttgtgattatattgttatagtacgaaataaatatttagatttagattttaattctaatctaaatgagctaaaatatttgtataaaaaaatattaaaaaggatggaaggttaaatggtattagataaaaaaactaaaaaaatcttaaaagtattttgtttggttttcctagtcgctattttaacaggatgtgcacaaaatcttgataaaaatggtgaacttattgcatctcgagcaataacaatgtcaacaccttggtcattaagtgcggggtggtttgatttcatatttgttattccattagcaaaaggaattttatttattgatcaatttgtgggaaatgtagctattggagtaattggaattaccgttgttgttaatattattactttaccaataatgatcaaatcaactgtatcaactcaaaaaatgcagttattacaaccggaattagaaaaaattcaacgtaaatataaaggtcgtaaagatcaagcttcacaaatgcgtcaaagtgctgaaattcaaaatttatacaaaaaacataatgtaagcatgtttggttcatttgcaacatttttaactttaccgattatgtttgctatgtggcaagcagtacaaagaattgatgatttgtataaaactgtgatttttgggattaatttaggtgataagccatttggtcatattctagaatttgatattggttatataatattgttattattggtagcaggaacacaattttttgcaatgcagattactcaaattatggctaaacgttcaccaaaatatcgtccaagccaacaaatgcagtcaatgaatacaatgaataatgtaatgacagtttttattgtttatttagctgcaacaatgccatcagcaatgtcattatattggattacaactaatgttatcaatatagtcagaactgtatatattcaatttttccatattgaaaaagtaagaaaagaaattgattcttcaactactaataattttatgaacaataagaagtaggtgaataaaatgatgaaaagatatactgcaaaaacagtgcaagatgcaattaatttagcttgtcaagatttaggggtaactatagaagatttaaattatgaagtaataagtgaaacaagaacattttttactaaaaaagcagaaatcgaatgttatactatttcaatggttcaagagtacattgaagagtatgtaagacgttttattagtgatatgggatttgaaatcgaaacagtatcatacttgcaagatgggcgtatctattgcaatataaatactagcaataattctatattaattggaaaagcaggagttattttacgagcaattaattttattgtaaaaaatgctgttagtactacatataaaaaaagaattgaattaagtattgatattaatggttataaagaagatcgttataaaaaagttgcttcaatggcaagaagattaggtaaacaggtattaagaacgaaatctgatatcaaattggatccaatgcctgctgatgaacgtaaagttatgcaccaagagttgtctaaactagatcatgttaaaacagagagtcatggtgaagggaaaaatagacatatggtcatttcatatgtagaataaacacatggtatcatgtgttttttcatataaaaatttaatgataggataaataataatggaatatacgataaaacaagtaacagaaaaatataatcttagtgcatcaactcttagatattatgaaaaagagggtttacttcctaaaataaaaaagaatcaaagcaataaaagaatttatgatgataatgacttacagtggctagatataattatatgtatgcgcaaaacaggaatgacaatagctcatataaaagactatattgaattatgtcatgaaggtgacgacacattaaaacaaagatatgaaatttttttaaaacaaaaagaaatcttattacagcaaaaagaggaattggaaaaaaatattgagatgataaattataaaatcaatttatatagtgaaaaattgaagtagaggaaaaaagatgaataaaaacaagttattaatattttttattattaatggactgttcaatttagcggctaattatgctcatcctattacacctacagttataaaaaatctaaatttagatagttatatgtttggtgtagcttatggagcaatgatgggaatgaattttttattctcaccattttggggaaaattaaatgagcaaataaatagcaaaacaacaatgttaatatgcagtattggttatgcgattggacagatactattttggcaagcaacatcgcaaaatattattatttttgcaagattgttttcaggagtttttacaggaggctgttatgtaagtttcttaacatacgttgtcaacacttcttctattgaaaagaggggacataatttaaccattctagcgactgtggcaactgtttgtgcagcatttggctatttcatcggaggtatgttaggagaaatttcgattgatttgacatttgccattcaagctttaactttagctggttgtggaatattattttatattttttgtaaaaatgatgtcttttcaacaaagaaatacaaattaaattttttgcttaaacaagctaacccgtttaattcatttaaacaggctaaaatatttatgaataaaaaatatttgattttatttagtatttgttgtttaaatttcttaggatttacagcatttgagcaaagttttaactattatatcaaagatatttttaatttaacctctggttataatggaattatcaaagcatcaattggttttatttctttagttgctaacgggactatttgtttgtggatcatcaaaaatgcagatgtttcaaaatcatcaatgttagtcctattattaagcagcattacgatgataggagttcttacaacaaataatattgttacttttattataatgaatgtagttttctttgcactaaattctatcattattccattgattcaagatttaatagtaaaatatacaactaataaaaataacagtatagttatgggattttacaatgcaataaagtcgttaggtgggattattggggctttactggctggtttcttttatacttttgatccccatctgccattcatatttggtttaatttcttttcttttagcaacacttttatcactttattatattaaaaatgtatctaaaaaataatgatataagtaacatggcataaaaatattgtaaaataatattattgtttgaatatcgtttaatttatgatattctttatatgaggataaattataaaaacgagagaaacaaagggataatattaaaatgattaagataacaataatagatgataaagaagaattttgtaataaaataaaaaatattttattacaaaaatttattgatatcaaagtatttacatgtagctccatcaatcaaattgataataattgtgattttatgatactaagtattgatttgtcagattatgatgcaatagaatatgcaaaagctaatgaagataaaaaaataatttttatggctaatcataatcaaagatttaaagaagcttttgggcctaatatatatggttatataaataaaaataacttagaagatgaattggtggaaaatatttcaaaaatgataaatagaataaaaaatcaatatatggtttattttaaaatagctggtgaaataattgaaataaaaaaaagtaatataatatattgtatgtatttaggagatagaaatattgcagtaatatatgataataaacaaattataattaaaaataaaacattaaaaagattattaatgattttaggaagtgattttattcttattaatcgtagtgttgtaattaataaaaagaaaatttcaaaaatattaaataataaaatttgtttagtaggaattaattgtatatttgatattagtcgtcgacaaaaaagtttagtattaaaagctttttatgaagataataaaaattattaacaaagatatttaaatatatgattgataatataaaatagtttaatattattaaacagaatatataaacgaaaataaagaatagagttatttttatttgataatggaaaaattgagattaatatattatatttattaaaagtaagagtaatcatagatttctattaagaaaagaaaatttatataagaaatattattattttaaaggtgatgagatagaaatcaaatttttattttttaaatcattgttataaaatgaaaatttgatattttaatttaaactggagtgattaaaatatttaaatatcttttattttctaaaactttactatttttttattaaaatcaaataataaactttggtctttaaatttctgtggggttttgattccctacttctgtttatagttgaaaaagtatcattcaataccgtgggatcaagaatgatacttttaatataccgaaacaatcataggaaacaatctggaatgcatatttacaaagcaatcaaacacacattgatgacagtagttggagaaatatgattcttttgagcaatagaggtaaaagtataatttaatcttttacagtctttgagaacctgcataacagttgcagtagaaatcctatgtgcaacttcaataaagggattatcttcaagaaaagttttgtgacagtctttacatacaaatcttctacatctgtaattgataacggttttattagtgttgaaaatagaatgagtaattttctttgatttatagtctttaacattagcattcaaactactgcaacaggagcaggatttaatctttttaattaaagtaacattaatgtttataatatcgtgagatctaacgatattgatatcttgaatatcgtcaggttgtaaacccaataaatttatagtatcataatccatgagataacactctcctttcaaatatggttgcatctgcaaaaacaatcataccatgaaaggattttttcatactataagagtaccccacgaaagtttaaagtacaaaaaaagcctataccatgaaactttatacctaggggtcgaccctacactaatttagatattgataaactttttgcaataattttttgatgaatgtctcattatttattatcactaaacaaaattttttaattaaaaaatgtaaaattataagaaataattataaagacatgaccgtttaatgatatttttaaccattaaatgctaaaaataatttatataatttttttgtgttataataaatataagaaaagtaataaaatttaataatataaatatatagatagtatagatatttatattttattaattagattataaataaaaggaagttaacttacttattgaaaggaggaattgcaaattgaaactaaaaaaaattgtatttttattattattattaattataatttcgggatgcaaatcaaacaatttaaataatacaaataaagaaaaaaaatataataatgaaataattaaattaaataaaaaaggggatcttgaaaaaatagtagatggctatatatttttttctacaacagactgttttttgtgtgaagaaatatatcccttagttaaagaagaaataaaaaaatatgaatttaacttatattactttgatattaagaaaatgttagacgataaaatttatacaagtgaagagcttttagatatatttaataaatattatattaaatatactccgacaattataaaaattaaaaatggaaatgaaatttcaagatatccatcagattataatcaagagatagaagaattatctaatgaattaaagaatttttttgaggagagatagttatgaaaaaagaaaatttttttaaatttgataaatttttttcaaaaatagcatttatttatattttgttaatcccttatttttttcaagaaagaaacaaagttttatttatttgttttagtttattattttttatagaaagattaatttatatttggtatatgagagatagtttttcaaataaaagaaaaataatttatttatcaattgctataatttatataatttgttctatatatatgattattaaattatttggcttaatttaattttatatttagattctacaaaagtaaaatatttgttactacattaatttaagatgtggggaatggaggatagtatgaaagaaattttaaagttaagtagaactaagataattttatttgttgtcattactatggtaattggtatgtttggatttagtgtaaatattgaagctaaagaaattgactatcaagatagtactgagattattgatccagtttataatgaaaatggagaattgatagaatttacagtagttttaaaaaatgctgatcctgctctattagaacaattatataaggaggttgaagaaagaaatattaatttaatgactactcaaatgaatgaaaacggtatagtacctctatcagttacaggagcaggtattattagttttgtctcaggagcatgttttgttttagaagttttaacaggatatggttgtgcagctgtagctagatttataggactagagctaattaatggattttatatgtataatggtaagaaatatactggaaaatggcaggttacacgtggatatattcctggttgtgaaccaagacattcagaaggatgttttagaacaacctatacaaaaattggataagtataattataaaaaaataatataaattaaatttttgccaaatattgaataattatttattttaagatttttagtaattttattggatcaatttgaatgaaagttttggactttaaatttttgtggggttttggtgaccccacttttattatttatagttgaaaaaagtatcattaataccgtgaggtcaagaatgatacttttaatatgccgaaacaaccattttatttaattattacctgtttttttatatggacctcttgctcttcctggttctttattcgattttttttgatctgtaaatattggtaaagagcttttattaatacaatacataatacgatttcttaatctttcaaaatttttatattttaaagctgtttttaatagaatcttaattctgccattaatagattcaattggcctatttgaggctctttttccgttaatgataataaatgaattgattatttctcttttctagtttttaagatattcacaacacctttaaactcattgatatttaatgtcaccaactgattataaagctcatcatatcttttgatgcgttttcgtatgtataatcttcattatcataattcatgagataacactttccttttaaatatggctgcatttgcaaaaataatcatatcataaaaggatttcttcgtactataagagtatatcactaaagtttctatcctaccttaaattagaaatatcttctatcttgtttagatgttttttattttttaatttatttggattttgatataaatataatggacttatttttttgtttgctcaaatcaatctgctacgagcatatccaaaattgtttaacctatagaattttttttaaatctttagatattctattaggaccattagacagttttcgtttattttcattattatcagtgatacaaataaagaataagtcagaaaattttctaaacatagataatgatgaataaaaataaagaatgattaagttatttaaaagaaaagcgtctctgtttaaatctttttcagttgttttgatgaattaaatatacttttcttttaagcatttaatatttaaaatgatgttatagaaataggcttatttttaaaatttatgagaccattgttctttttacaagattcctcataaaatattggacaagacgaacttaactcttatatttaagtatctagaatcttgacataataccaataaaaatattaacttatattatttttcttcacagccaaagataatatttgcactttcacgggctttggttagtacgtccattacaattctagaatgttcaagcatctcataacatatatcataatttttattatctatgtaactagccatttttttaaactcttcatacatacgatgatatttacttgaatcaataatttctctttcgccattatttttgattatttgaacatcacttaaagtacttgttggaccttctattttaatacaccctaaatcaccttgaattgttgaagtaataggagcaccacaatctttagcaccaatacaaattgctttaaaagttggatattctaaacatacgatacctgatgtatcaatacctttttcaatattagctaaatattggactttatctggttttccaaataaaccaattgtaaaatgaatgttataaacatttaaatccattaaagctccaccagattgattaatgtcaaatacaggtaaaatttcaccccgtttaaaagcatcatagcgtgaagaatattgtgaataattacatgaaataatactaatttttccaatttcatttaatttttctttaatttttttataagctggtaaatattgattggtaattgcttcaaagagaagacaattttgctttttagataattcaattaattcatcaagctcttttacatttgaagtaaaagccttttcacaaataacatgtttattacataataatgcttttttagtatattcataatgaagatgatttggtaaagcaatataaattgtatcaatttcttcatccttcaataatgcatcataatcgtaataagattttttaatatgatatttattaactaatgtttctatttttttctttgattctttacgtcctaaaatagcagttagttcaatttcatcaataatctcaataaaagataataaatcatggacaatcatgccactaccaataattccaagtttcatttaaagtttcctccttgtctaataatattataacattgtttgggtatattaattaataataatttatgataaaatacaaaagataaaggagtgatattttgaatgaagatataattgttgctgttgcaacaagtcgtttagaagctgctatttcaataattagaataagtgggcctgattgtattgcttttgttcaaaatttttttactggtaaaatacttgaaaagccaagtcatacaattaattatggttatataattgacgaaggaaaaaaaattgatgaagtgttagtcaatatttatcgtggaaaaaaaacatttacgggcgaagaaatggttgaaataaattgtcatggtggtgtatatattacatcacgagttttggaagtatgtataaaacagggtgctcgaatggcagaacgtggtgagtttagtaaaagagcttttttaaatggacgaatagatttatcacaagcagaagcaattagtgatattattactgctaaaaatagttatgccacagatttagcattaaaaggcattactggaaatattagtaattttattgaagatttaaaagaagatttaattaaaattattacacaaatagaagttaacattgattatcctgaatatgatgatgttgaagaattaactgcgacatctttattaccattaagtgaaaatcttttaaataaaatgaataaaatattagatgattctaaaaatattagtttgattaaagatggtattaaaacagttataattggtcgaccaaatgttggaaaaagtagtttattaaatgcactgttacaagaagataaagcaatcgtgactaatatagcggggacaactcgagatattgttgaaggaagtattagtattgatggaattgttttaaatatgatcgatacagctggtattcgtgaaactgatgatcttattgaaagtatgggagtagagaaatccaaagaattgattcatcaggcagatttggtattgttagttattgatggttctatggcattagatgatgatgattataaattactagatttaacaaaaaatgaaaacagaattgttgttattaataaaactgatcaagaaatcaaggttgatatagagggaatagctattagtgctaagaataatgatataaataaattaataacgcagattaaaaagatgtttgaactaggaaaaatcattgataataatgattatattttaactaatgctcgtcaaacaatgctattacaaagagccagtcaagctttaaaacaagctgtagaagcaatgaatttgatggttccgactgatttgatcgtaacagatttatatgaatgttggaataatttaaaagatatattaggggaaaaagcaaaagaagatttattagatgagttatttaaacgcttttgtataggtaagtaaaatggatagaaatcaaatattatcaacaaaatttttaaatatttctaaatatttaggaattatagcagcagtagcatttatcatatttttagtagttaatgcatttaatgtaggaaataaaatattattttggtttagttatatattattgataattgctttagttggcacgatccaatcaatatgtttatattttattggtaaacattttaaatcaaaatctaagtaggtgatgaaatggaaaaaatttatgaacagatagatagtttatttgttaatggattgattaatagtgctattagtattttagtattaatagttgttgctgtaattgtaaataaaattattaataaaattatgaaaaagaaaataactgatccattaaagttggtttttccaatgcgtgtaaaaaaagttattttagtaacaattgttttagcaacgatcatgagtgaaattacatcaatgcaatcgattatcagagctcttgttgctagtgggggaatcttagctgttgttgttgggctagcctcacaagaagctgctagtaatatgatcaatggttttatgatcattacatataagccttataaaataggtgattttgtaaatgttcaagaatataatgttaagggaacagtaatcgatatatcaatgagacatagtattattgaaacaattgaaagaactcaggttattatacctaatacaattatgaacaaggctattatcgaaaatatttcaaatgtaaaagcccaaaaagctaatcatttgtttattgaagtatcatatgaatgtgatttacaaagagcaattgctataattcaagaagaaggtgctaaacatcctttatgtttagatggaagaacaaaagcgcaaaagaaaaaacatgaaccaactgttaatgtacattgtgttgaattcaatgaaagtggaattcaattaagagcaactgtattatcaaaagataatatttctggttttcaattattatcggatctaagattaagtattaaagctcgttttgatgaagaaggaattgagattccatatcctcatcgagtatttataatggaaaataataatcaatcgacaaatgaaaaagatggagaagaaaaaaccggagactaatcatcttgattagcttccggtacttttttatctatcaataacttaatttttgtaatacgattaccttttacaccagtaatcttaaatgttagatttttatatgttacagtacgttcttgattatcactaggtatttcacctaataaatgaataacgaaaccactgattgtatcatgattaatattatttaactttaaatctaattcatcatcaagatcatcaatcaaataatttccatctataatataattataatcatcgattttctgtaatttaggttcatcatcaagatcatactcatcttcaatttctcccataatttcttcaattaaatcctcaactgtaacaattccagaaaatcctccatattcatcaactaaaatagcaatatgctgatgatcttcctgtaattctttaaataaatcatcagtattttttgtttctaaaacaaaatacggttttcttaatatttttttaatatcaacattatcaaatcccactttacgagcttctattgaaaaatctttcatatttaaaattccaataatattatcaatcgaatcatcataaacaggaattcgtgtatactgcattgtcatcatttgatcaatattctcacttagaggatcgttgatatcaatacaatatacttcagtacgcggtgtcattatatttaaagcaagactttcatcaaattcaaaaatattagtaatcatatcagtctcaatttcattaaaaacaccagtttcttgaccactttcaaccattgaacgaatttcttcacgtgataaagattcttcaacattttcatcactcataccaaataattttaaaataaatttagtagaccatgataatattttgataaatggactagcaattttactaataattaaaattggtttagcacaaaacattgaataccattcagccttttgtaaagcaattctttttggtactaattcaccaaaaattaaagtaataaaagaaattaaaatagttattaaaactactgcaattgtatcagaataaggaactgaccaattttttaaaatattcgctagactgacagaaataccagtagcagcacttgcagaattaaaaaatcctgctaatgtaatcgctacttgaattgttgataaaaagtttgttggttgatcaagtaatttttcaactaacttggcctttttatttccttcttcacttaaacgacgaattttattcttgtttactgaaacaatagccatttcactggcagcaaaataagcattaattaaagtaagtacaacaattaaaactacttgtaatgtgattgaagactcggggcctgcatccataaattaaaacactcctttattaattaaaattttatagaaaatattctatcaaatacatattaacttgtaaatatagactaattattaagattgttaagatttgattaataaatgataaaacattgattaaattataaaagtaattaatacttttaatttataatattatattttatcctgtttaaactaattagatggcctagaaagttaaaatttaagtttgaaaataaaatctgacaccattttcaatattttcgacaccatatttaaaatgatgcaaatctaaaatagctttacatatagctaaacctaagcctgtaccattttgatcatctttaataaagctaagccaaatattttctaacttatcttcactaatgtgtttacccatattttcgacatacaatgctttatttttaataataactttaataattccatgattatttgtatgtttaatggcattagttagataattttttacaaccatctcaattttaaatttatcagctgttattgtagaatcatcgctataaaaatcaactttaatatttttgattttcaataaatatgttagattgtctataattgcagtaactaactcatttaaattaaattcttctaagtctagtttgatatgatttgattctaattttgatagttccagcattgcgagaactagctgatttattttttcagtttgttcatttataatagatagataacgttctttttttatattatcatcacagtcttctattaattcactataaccattaataattgctagtggtgtttttatttcatgggtgaaattagcgataaattcttttcgaatattttctaatttttttattttaataatattttcatttagatcagcaatgttattttttatcgtattattcattatatttatattatgagctaatgagcctagttcatcttttgagttaatctttaaataatgatcaaaatttcctttagttatttctttggtagactgttcaattaacttgattggtttagtaataatttttgaagcaacgacacttattaaaattacaaataaaacagataataagtaactatagatattatcgtttaaatagtctataaatacatttttatttaaatcaggatacagaccaacttttaagatataaccaaaaggttgataattgttatcttcgatcgctgcatatgaatagacaacagttgtattatcttgttcataacttccttcttcataagtattagtaacttttgaagctatctttttttcaaaaaaaggatatgagaaaagaaaataattatcaataggcttatttttttccaatttatagaaaaatgaactaatattatcaataaaaatagtttcaatgtctttataagcaccatcaataattacttcattacctattttcaaataagctggattatcaataattcttatattatcatttgtcatttcaaaattagtagtagatacttctacatttaatccattatcccaattatcactgatcgtcttaacaattctaggaatatctttagcattaatattgatgtaaatattattattatcatttaaaaaacctatataatcaagattatggataaagaaaatatcagacattccagaagcattaattaaattgccatctttatcagcaattaaaatatactgttctttagtattattacgacgttcttctaactcatcttcatcataatctttataaagagtataaaaactttttgattcttcattagtatcattgatgatttcgttttttaattgatcgatcgtaagatctttatgatcaatagctgcattataaatagcatttttaataacatcaacatattcattgtcaattgatttttctttaatagcagcatttttataacgattataaccctggtatgcttcaaaacttaaaattactaaaaaactgattagaacaatagcagtaattttaaatgttaaactaaattttttcatatctttcacctactttcatttataattatagctttaatatgtgtaggtcaagtgttgcttatgtgtaatttaggtgaaactttaaatagtattaataattatttgataattatcagtatctaattttttctgataattaaaatcatgggcttcaattatttcaaatatgtcatttaattcttcaaactctttgtttgtaatagagtgatcgttattaataaaataaatagttttattttcaatcctaattgttaaagtatcatttggatgactgtgactaataataaaataatatatattattgattactttagttaattcatctttattaccaagaacaactaaattattaggtaaataatttagtttcaattttttaaatactaataaatttttactattattatataattctgtaagttgtttttctaagtcaaccgactctttattaaaaacttcccttttaggtttagaaggaataatattttcttctttttccacgatgatcgtattattttcatgattgatttttttaataacaaaataactaacaattataattaataaagagataagataattaaaataatgatcagataaataatttacaaatgtataactattactatccctttcataatcacaccatactatatatccactatcaggatgaaggaaaccataaagtttttcttctgtttgttcatctgtataataagcaccatatttataatctaatatttgaaaacaaatttttacatcaactttaatatgctgatcattttcatcataataatcgataggatgaatataatcattaactgggtttataacctcataatagccatttttatcaaacttttttgatgctactacatcatttaaactatctgtaaaataattataaatattataattattatcatttatataagcattattattttcatcaacaccataatgaccaaatggggtacttaaaaaagtaatttctttactgattaaattatcaaaatttccattgtaaaagacaattccatctatttcaaaataaagtatttccttaataacgatcgtcccatcatctttaattgcatcataattgaatgtagcaacaactttttcctttttatcaatagaatcacgtaataaagtataaatattttttaatgtttgtagatcaaaatgttttaaactaatcaaattttcagatatattttctgtttcataagaaaaaccaatatcttcaaaattattattataaatcaagttaagtgaatcatcaaaagccataaagtttaagaaataatttcgattaatattattttttacaatatcttcaaaagatccaaatcttaaacttaaatcatcatttatattttttacaatatttaaagaagaagaaatatgctcaggtttatttttttcattttgataatcttgataagtatatagagcattaatggtaatgatacttaaaatacaaaaaagtatcaattttacatttttattaaattttaactttttcatcttaactatccacctttgaaaaaatataaccacttttacgaatagtctttatataatttaatggagatattaatttacgaactttttttacataagtatcgacagctctaccatcaccataataatcatatccccatagatcatttaataactgttctctagttaataaacgatcatgatgtttaataaaataagccagcatagcatattcttttggcgcaaattttattttttgatttgcaatcataacttgatgaaagttagaatcaagagtaatctcaccaaatttaatgatatcatcagtatctttatgataagtacgtttaattatcgctaaacatttagcatataaaatggatggtttaaaaggtttggtaatataatcgtctgctcctaattcataggctaatagctgattgtcatctaatgataaagcactgataaaaataattggaatgtttgaagaatttctaatttgtttacaaacctcataaccatctataccgggcatcatgatgtctaataaaactaaattaatatcttcattgattaaattcaatgcttcataaccatttgctgcttcaataactttaatttcacgtttattaaaatattctgatataaaatcacgaactagtttttcatcttctactaataaaatttgatacataatatttccctcctattattattgtaccattaattagtgtaaataaagtgaaagatagtaaaataattagtataaaaaccccgataggggttatttataattcacattaaatcttttggataaagaattattgtttttaagcgcatcaatgaaatcataaatgcatattatcgattcatcaatactcttattaaataagtcttcaagataattaatataaggaataatttttttattagctcgataattaacaataaatccttgaaatcttttataagtaaaagaaataagcaaaacaaaataaatcaaacctcttttatatagttgcggagcaactaatagatgatcataaaatttcattcctttaagagacttttttaaatctttttttgaagcttcaaaaaaaggttcaatcgtattaagaatacgatcattgattaaaatatgatcagttagatgggttcttaaaggatcacgatcatcttttaacataaaatcacgatctagttctgtttcaatttcaaaatgagttaattttgtttcttccataactatattgatataaccatggcaattgctatccaaaataaaatgacaaataaaaccacacaaatacgcaaattgggcttcattttgtgatttctttaatatcgatagagctcgattaaaaaaaatacaagctttttcttgatgcatagcacttcctagacgatttattttactatgaatgtaaggccgattataaaaaagaatatcaggaccatgtaatcctagatcaaataaatcacgattatcaagaataattttttttaaaggatattttaattggctaataacttttttacctaaacgataatgactataagcagctggcattatttcaacatatcatattcagctggtttaaaaccaactaaaactttatcagaagattcaacgattggtcttttaactaacataccatcacttgctagtaaagaaagctgttcatcttcactcatttttgataatttatcttttaaatttaattctcgatattttaaaccggatgtgttaaaaaaacgtttaagcggtaaaccgctttttttatataatgctaaaagttcgtctttacttaatttctcttcaacaatatgacgatcagtatgttctaagttaagattatcaagatatttttttgcttttttgcaagtactgcattttggatattctataaattttaacattttatcacctcatttatagtttaactcatttaactatatgataacaacaattaagctaaattaattcttgatttatcatagataatgaaaaaaatttgtcaagttgcatagtttaaaaatagatgataacatataaatacgttttttgtttaaaagaatcttgataaattctaatgtttaaataaaaagaggaggtaattatatgtggggaattattgctacatggcaaatggccctggatggagtcgaaaaagcaacggaaatgttaaagaatggcggtgatgctggcgatgcaatagaaactgctgttaaagaagtagaagattttccatattataaatcagtaggttttggtggtttgccaaacgaagaaatggaagttgaattagatgctgcttatatggatggagatacgttagatatcggagccgtagcagctattaaagattatgccaatccagttgctattgcaagacatttatcaaaagaaaaggtaaataatctattagttggtcaaggaggcgaaaaatatgctcataaagccggttttgaacgaaaaaacatgttaactgagcgggctaaaattcattatcataatcgtatcaaagaagttagagagcaagaaataaagccttatacaggtcatgatacagttgggatggtatgtttagatacgcatggaaaaatgacctcagctacttcaacaagtggtttgtttatgaaaaaggcgggacgcgttggcgattctccacttgcgggatctggcttttacgttgacagtaaagttggcggagcgagtgctactggtttaggtgaagatattatgaaaggttgtatgtcatatgaaattgttcgcttaatgaaagaagggatgcatccccaagatgcctgtgaaaaagcagtcaatatgtttgatcaagagttaagagaacggcgcggtcaagctggtgatatctcattgattgccatgaataatcagggacaatggggtgctgcaactaatatcgaaggtttttcgtttgttgttgcaacagcaaaacaaaaaccaatagtttatttaactaagaaaattgatggtaaatatattcatgaagctgccagccaagaatggatagataattatataacaacgagaatggcaccattagttaaaaaataatgagatgtaagaaaagatataatttgatttatatctttttttaataatgtttatattttgtattattaactaaaataaatatagtgaaatttggcaaaattaattaaagcagatctaataaaaattacgctactagtataaaatatatgataaaatgacaaaaagaagtgataaaagtagttaattattcctaaaatggaggaaacatatgaataataaaataaataaagaagagttaaaggatattttattaagtggtgatattgaaaaaataaagaaaataatcactaatattcatcctgcagatattttagatattcttcatgaagatgaagatagtataaagaagttaatggataacttacctaatagtgttgtggctagtgttattgaagaagaagatgatgaagatgatcaatatgaattactaaaattattttcagatctcaaacaacgtaaaatattagacgaaatggctaatgatgaaattactgatttagttggcgagttagaagaaaaagaaaagcaggatattttaaacaaaatggataaagacgataaagaagatgttgaacgtctattgacatttgaaccagatactgctggtggtataatgactacggaatatataagtattcgagctttaaatacagttgaaaaaactcttaaatatttacaagaaaatatagaacaagatgcggcttattatttatatgtagtagatcctcaaaatatcttaaaaggagttgtttcacttcgagatatcgttactaactcttttgatactaaaataatcgatattactaatcctaatgtgaaaacgatcatgtataatgaagatcaagaagaagtggcaaagaaatttcaaaaatatggctttattttaatgccggtagtagatgaaatggatcatttattaggagtaattgagtttgatgatattattgatgtaattcaagaagaaaatacagaagatattaatttattaggtggtgttgattctgaagaacgtttagattcaactgttagtgaatcatttaaaagtcggataccatggttaatagttaatttatttacagctgttttagcagcttcggtagttagcatctttgaaggaacaattgctcaagtagttactttagcaactgttatgcctattgttacaggaatgggcggcaatgcaggaactcaatcattaacaattgtagttagaggattatcactaggtgaactaacaaaagaaaatgcaattaaaattatgtttaaagaaattgcagttggatttattagtgggatagttattggaattttagttgctttaggctcaatggtttttgaaggtaatcctatatttggtgttgttactggattagcgatgtttttaaatatgattttagcaaatatcgcaggttattttattcctgtaattttagaaaaattacatattgatccagctcttgcaagtggggtctttgtaacaacagttaccgatgttcttggttttttcttttttcttggactagcaacaatatttttatcttatttaatttaatatgcagaggagaaaaattactatggaagaaaaattggatgaaataataatgttattaaaaaatatcgattctaaattagatgttttagttggtgataaacaggcacagatgttaaaaaagcctagtaacgaggctatcttgaaacaatttgaagaaacagaaaaactgtttaataaagttatgaataaaggaaaattgatctaatatgctattttaattctttcaattttgtaagcttacaataatattgaataaaatatagtataatatatatgggtgatttgatgaaaatattaataattgaagatgatttagaactacgagaagaattaaaaatattattagataataatggttatcatggagtaattttacaaagacttgataatgctttagaagaaataattaaaatagctcctgatttaattttattagacattaagttaccatatttaaatggacaacaactgttaaagcagttaaggaaaaaatctagtattccggtaatcatggttacaagcaaagatagtgagatggatgaaattttagcgatgagttatggagcagatgattatattacgaaaccttataacccaacgattttattattgcatatcgaggctgtttttaagagattacaaaataaagaaactaaattatattatcaaggtgttaatgttaatttgtcaaaaagtgttttagaaaagaatgatcatgaattattactgagtaaaaatgaaatgagtattttttattttttgttagttaatcaaggaaagatcgtaagtcgcgatggaattatgaattatttgtggggaactaataaatttattgatgataatactttgacagttaatatgacaagattaaagaaaaaacttgtaaagattggcttaattgatgtaattgaaacaagaagagaccaaggatatattttaatatgaaaatacgtagttatataaaagataaatttgttgattttattttatggtttttgatgattttaataattgaattatttttgataatgtttaaagtggtaaatagtttgattattgttgtttcaataactttgataatatttatgatcattattcatagttatgattattatcgaaaaaaagagttttatcaggattttaatactaaattaaaacaattagataagaaatgtttgattagtgaattaatcaagaaaccagattttttagaaggacaaatattatgtgattcattatatgaaattgataaatcaatgtatgaagaaattgaaacttattttcaaaatataaaagattttaaagaatatatcgaattatggattcatgaagtaaaactgccgattgcgagtagtaaattaatgattcataatcatgaaactaatgaaagaaaattaaaagaacaaattaatagaattgaaaattatgttgaacaggtattatactatacgcggttagaaaatagtgaacaagattatttattaaaaaaatgtaatttaaaagatattataaataatgtaataaaaagaaatcaagatagttttttgtatcaaaaaattaagataaaaataggtgatattaataaaactgttttaagtgatagtaagtggcttgaatttattattaatcagatcgttagtaatagtattaaatatcgtggaaaagagaattgtaaaattagttttaatgtaatcaaaaaagaaaatattattttagaaatcattgataatggaataggtattgatcaaacagatataaaacatgtatttgataaatcatttacgggaaataatggtcgtatagtatctagttcgacaggaatgggcctttatatttcaaaattattatgtgataaattaggacataagatcatgattgaatcaaaggttcaacagtataccaaagtgagcatttgttttgaagatgaagagtattacagaatcgtaaggtaattgtaagatacatcgatgttactacaattactttttttctataataaaagcaaggaggatgaaatatggaaaatgtattagtaattgaaaatattagtaaatattatggtaataaaagtaatcttactaaagctttaagtaatatttcattgaatgttgctaaaggtgattttattgcgattatgggagcgagtggttctggcaaaacgactttgcttaatgtaatttctacaattgatagagtaacagctggccatatatatcttgaaaaaaaggatattacaagattgaaaggaaatgaactagataaatttagaagagaagaactaggttttatttttcaagattttaatttattagatactttgacggcatatgaaaatattgctctagctttacagattctcaaggttaaagctaaggaaatagatattcgcgttaatgatgctgcaaaaaaactaaatattagtgatatcttgaacaaatatccctatgaaatgtctggaggacaaaagcaaagagttgcatgtgctagagcaatagtgactaatcctaaactaattttagcagacgaaccaacaggagcattagattcgaaaagttctaaaatgttattagaaagttttcaacaattaaataatgactatcatacaactattttaatggtaacgcatgatgtttttagtgctagttatgcttctagagttatttttataaaagatggaaaaatttttaatgagcttgatcgtggaaatgatgagcgaaaaatattttttgaaagaattattgatgttgtctcaattttaggaggcgatgtaaacgatgttatttaatttggttttaaaaaatattagaaaaagttttaaagattatgcaatatatttttttacattagtattaggagtagcaattttttatatttttaattcacttgaaagtcaaacagtaatgttatctttaactaaatctacaaaagatttaattgaattaatgacaaaaataatatctggacttagtgtttttgtatcatttgtattaggttttttaattatttatgctaatcaatttttaatcaaacgacgaaaaaaagaatttggtatatatatgacattaggaatgtcaaagcaacaaatttctaaaatattattgggtgaaacaatttgtattggtcttatttctcttattattggattacttatcggaattattttatcgcaggtaatgtcaattatcgtaggtagtatgtttgatgctgatatggataaatttgtatttgttttttcaaatagtacatgtattaaaacagttatatattttggaataatgtatctgctggtaatgttttttaatactattcaaattggtaaatgtaaattaattgatttattggctgcagataaaaaaaatgaagaaataaaaataaaaaatgtatttctttgcagtctagtttttatcttttcaatatctttattgatttatgcatattacaatgtaacagctggtgctagtaatttagatacagcattttcagttttgttacaaatgttttatggttttctggcgacgtttttaattttctggtcgttatcaggtttattgataaaagtagtaacttcattaaaaggagtatattttaagaatcttaatagttttacgctaaaagaaatcagtagtaaaataaatactacagtattttccacaacgattatttgtctaatgctatttattacaatttgtatcttttcaacagcttttactatgaataatagtactaagaatgtgatgaatgaattagtaccagctgatatacagatcagtacaaatactcataactcaattaaacaagaattattaaataataaaataaatgtaacagaagattttaaagaagttctagaatttaatgtttatcaaagtaatcaattaacactaagagatacctatggtaatgaatttacagatgcaacagaaaaatatttaagtacttctgaagaaattgtaaaattgagtgattataataaattagcaaaactatataatcttccaacatataatttaaaagatgaatatgtagtcgtttgcaattatgaaaatatcaaatatgtaagaaataatcttttacaaaataaaccagatatctttttgaatggaaaaaagtatcgtagtaaatttgatcaatgccaagatggttttctaataatgtcatctagtcatatgaatggtggtttttatgttgtaccggatgaagctgttgaaaatatggaagtaagcagcagctatttagtggctaattataatgtcagtaataaaaaagattatgataaatttattgtcaataaaattcctgaacttagtgataatggattatcagtcaatacacgcttagatatttatagtacgacaattggtatgggagcaatggttatttttgttggtttatatcttggaatagttttcttgatttctagtgcggtaattattgctttgaaagaattatcacaaagcattgataacaaaggaaaatatcaaatgcttagaaaattaggggtaagtaataaaatgataagtagatcattatttagacagattgctatttacttcagttttccattaattttggctattattcactctatttttgggattcaagtatgcagaataatgattagttctactgcagtatcgtttgatagtttaattaatagtattttaataacagcatctatattaattttaatttatggtggttattttttagtcacatattggtgtagtaaaaatattattaaggatgaataaatttttagtcttaaaaatattcgaaaaagaaattagaaaagacaggggatctataaattgtattaattgaatttaatctcttgtctttttatgattgttggaaatagaattaatattatatttaaataataaaaaataaaaaaacttaaaaatatgatactagtaaaaattgtattaaataagaaacaattatcataataaattgcattcgtttgctttacaaaggttaatgtatgcgctaccataaaagtataaggcagagaaataatatgttaagtaaataataagcgggaacttaacaaaaaggaaatggagtgatttgaagaataataaactaaagaaaaaattaaaattattagttagaagggaaaagactatgaagaaaagaaaattaattaagaaaattggagttgctgctataactgctgcaatggtattgactagtgttttttctatttccactttaacagtgaaagctgaagaaatcgatacacaagaacatgtattaggttcagtaagtgatgtaagacaagaagggaataaagtatatatcacttatgtaagtggagaaaaaacaaagattacttttttagaagataatttgtttagatttaatatggatccagatggggatttcccagaaacacctgagcctcgttcaaagagtcatacaggtgtaatcactcaacaaagtgatgaatctgatgaatatagtaaaccaataccaagtctaagtgaaggggatactataaaaatagctactaataaagtagaattgcagattgataaagaaactgcaaaaatgaagttaattgataaagaaaatgataaagtagtttggcaagaaaaagaaccattaaaatatgtacgtgctcatatttttgattacgatgatccagaatttatgaaagactggtatcaagatgaatatacagatggaagttacactattcaaactttagaaaatgatagtagtgctcaatattttggtggtggaacacaaaatggccgttttaatcatactggtaaaacaattaatattgcaaatgaaagtgcttggacagatggtggagtagcttcaccaaatccattttattggacaactgcaggttatggagtaatgagaaatacttggcgtgcagggtcttatgattttggaaatacaaaagcagacgaaacaacaactttacataacgaagatcgttttgatgcatattattttgtcgatgacacaccaacggaattacttcaggattattataaaattacaggtaatccggtattatatccagaaagtgctttctatctaggacatttaaactgttataatcgcgatgcttggaaacaaaatgataacggtaagtggttattagaggatggtaaaagatatactgaaactaatcgtgaaggagtagcacttgagggagaaacatttagaaacattaaatggaactaatgatgatgattataaattctctgctagagcagttgttgatggttatgttgataacgatatgccatttggatggtttttaccaaatgatggttatggttgtggatatggtcaatctgatgatcctgtaacaggaattgatgataatgtagaaaatttaagacaatttactgaatatgctaataaatttggtgtaggaacaggtctttggactcaaagttacttaacaccaatagcaggaactgcaccacatttacaacgtgattttgaaaaagaagtaaatactggtggtatccgtactttaaaaactgacgttgcatgggttggtttgggttattcaatggctctatctggtttggataaagcttatgatattttgtctaacactggtgaacgtggtacgatcattacattagatggatgggctggtacacaacgttatggtggaatttggactggtgaccaaactggtggtaactgggaatatattcgtttccatattccaacatatatcggacaaagtttaagtggtaatccaaatgttggtagtgatatggatggaatctttggaggttcttctttaataacaactcgtgattaccaatggaaaacatttacaccattaatgttaaatatggatggttggggagattatgcaaaaaaaccatataattttggtgaagatactacttcaatcaaccgtatgtatctaaaattaaaagctgaattaatgccttatatttatacaacagctaatgaagctgtaactggattaccaatgattcgagcaatgttccttgaatatccagatgatccaattgcatatgatgaaaacagtgtacgttaccaatatatgtttggtgaaaatttcttggttgcaccggtttaccaagatacaaatatggatgaacatggtaatgatatccgtaatggaatatatttacctgatgaaaaccaaatttggattgattactttactggtaaacaatatcgtggtggaagtttcttaaataacttcgatgcgccattatggaaattaccattatttgttaaaaatggtgctattgtaccaatgtacgaagaaaataataatgttgccccaatcactgaaactaatccaaaaggattagataaaacaaaacgtattattgaattctggcctgaaggaaaaacatcatatgatttatttgaagatgatggtgttacattagattattctaataaagaagaagttaattatggaagtagtgtttctactagatttacttctgaagtaaaagatgatgaagctgttttacgtgcagaagcttctaaaggaacttataaaggttatgattcaaatagagatactacttttgttgttaatgtttcaaaagctcctgaagctgtaactggtaaagtaggttcttcagctgttgaatttaatgcagttgatagtaaagaagcttttgataatgcaactggtaatgtttattactatgatgaagcacctaatttaaataaatatgctactgaaggaagcgaatttgctaacgttgaaattacaacaactccaaaattatatgtaaaagttgaaaatacagatgtgagcaaaaatgcaattgaagtaacagttaaaggatttgaaaataaacaagacttagctggtaatcaagagactgatactttaacagctccaacaggtcttgtagcattagaagatcaaattactccaactgaaattccattagtttgggatgtagtagaaggagcaaccgaatatcaattagaaattgatggtaaaatcaattctggtataacaactaatgaatttttagtaggcagtcttgcatataactctactcacacatttagagttcgagctgcaaatagtgatggatattcgccatggagtgaggctttgagtgcaaagacaatagaaaatccatatcgtaatattccagcaggcatggaagttacaactaacgatagtgcagcgggatattcagctaagaatctagttgatcgtgatactaatgcatattggtgccggtgttaaggctaaaagctctgcttttgtcaatataagtctaaaaaaaatttgcttttaattcgcaaaaagcaccactgttttcatccagtgatgctcctgcgaacaatcttattccgtttatgctttttcttctttgtagaaaatgtcatccatcttccagcttatctccatacgacctggttcataaataaagactttctcaataatctttgacagctgtattttgtcaaaatcctgcaatgctgcaatctcatttacttccatttctttttctgttgcttcatcacattttttcttcgctactgcaatctcattctccaattctgctatctgcaaagtgatttctgaaatacgggaagtcgttttttccagttcttccatatacccttccttgtccaacacttctgaacgataatcagaatacagtttcatttttcttgacgagagtcgctttttttcactttccagtgttgcgatattttcttctttcaaaattgttttatgccattctcttttctttttctcaagattttccgaaatgaattgtgccatatttctggctgcatccagtactgtttcttctgcttctttcctgtccattttactttccgcacacccactaagaccgctgatatgtgcctgcatacagcgatacccagtctctctgctggtaaaaccaagtcttcttccacaggtcgggcaaaagaaaatagggcaggctactcctctttttgcaagaacttttttctggttagtaaacgctttctcatttgctttccggaataattcatcggatataattggttcatgtgcattttctacaacaatccactcctctttatcattggaaaccaatttattgcttcctgttcttgccactctctttttattccaaataatttttccaagatacacttcatttttgagcatatctgagattgtcgtgactgaccagagtttcttttctttttcgttttctctgtgcatttttataccttttctgcacatatactcccggcatgtaagcacatgggtttcgttcagatattttgctatctgtccttttgttttcccatctgccgccattgtgaatatcagtttcactatttcagccgcttctgggtctataaccagatgatgcttatcttctggatctttaatatatccatatttgggaaaagccggcatatattcaccgtttttagcatgtgttttcatagcagaacgaacttttctggacaaatctttgctgtacattgcattcagcatattttttaacgctacactcattcctccagtaaaaccagaggaattgatactgtcaaagccatcgttaattgagataattcgaataccaaggactggcaggattttttccagataattccccacttccagataatctcttccaaatcttgaaaagtcctttataacaatactttttatacgtcctgcttttgcatcttccatcatcctctgaaagccaggacggttaaagtttgtaccactgtacccatcgtctacatattcaactactggacagttagcaaattcgtcctgttttttgataaattcgtttatcagcattctctgtgcactgacactgttactttcggcttttatactgccatctacatcattatcctccgacgaaagtctgatataaacagcgatacattctgttactggcataactcagcctcccgttcttttgcatattttcttaattcttccaacatatcatcatacaccaaacgtaccgtaatagaaccgctttcatgtatttcgattttttctacaaaagcattgaccatttcctttgtcagcgttctcgtattgcggtatttattgatcaatgtttcccattcttcctctgtgtgaaaatttttttcatatccaacctgatgctttaataaaatttccatgttattctggatctctttttctgtttccgcatcctgctttgaaaatgtttcatactgctctgcatcaataatacggcacacataatcctcaaacaatctttcccggtgtactgccactttttccagttctttccggcatttcttgatttccctgttaaacacatcatattttttaatgctttcctgtctttgattcaaccgccgaatcaaatctacattttcaacatatacattgatatgtgcacgtatcacacgcagtacataatcattcacttccaaatcagtgatagaatgtggcgtacacttcccgtagagcttattatttccacagtaaaacctacgatgattgccttttgttttcccatataaatacatggtttttccacagtctgcacatacaattttctgcttgaaaaagttgaagtctcttacattattgccatttgatttacgagcttcattaacccgttttacgatatgaccaatcttttcctgtacctcatcaaaatcctttctgctcacaagtgcctcatgggtatttttgatgatgatccattcttctttctgattcattttctgtctctgtgctgcccaggaatcattggtaaactgattatgcacactatcaccggcataatattgattctcaaggattttgtggactgttcctccactccatgtccatgtcgctgacttttcatttgcttttcctgctttatccagcttgtaggctttcgggcagagatacccatccgcatttaatttccgggcaatctctgcataagtcattccatcaataaaatactgaaatatctttttcaccactggtgctgctaccggatctggaatcagctgatgaggattatccttgtctttttcataaccataagccatctgaccggaaggaaattcgccatttgcccagctcgtccggtatgaacttcttattttctttgccaaatctctggaataaaactcattatacacgtttgacatgctgatcagcaggcttatgtcatctctgaacgaatcataatgatcattcaccgaaataaaacgcacattaaagaatgggaacactctttcaatatagcttcctgcctctacataatttcttccaagtctagaaagatctttaacaataacacagtcaatatttccctctttgatgtcctgcatcatctcattaaaaccatctctctcaaaattagttccggttttagatatatcataatattcctttgcaaccacgatatctttctgttcttttacgaaattatgaagcagaaccatctgcgtttctatcgtatttctttctctgttcttttcactctcataggaaagccttgcataaagggctgcatgtgaaactttttcacactggttttcagcttctgtaaccaaattttctttatttccaacatttacataatctacttttcttgattttcgagccatttatacgacctccctcttttgaatttctattcttccgtccatacctgtgctgacatcgcatcccaccgactgtatctgccgtaacagagattgataacaatcatcaaaattaaatctgacttcaatatgttttttgtcatatactaatatctggtcaatcagttcaacagcaacagttcttgtaagttcctgtatattctgatgctcggcaaaataatcaagccaatgatatttatcactttttgattccaggacttcactgatctgttgatcaatgcttcggactgcttcctcggcttttttccgtttttctgtgtacccgtcatgaagctctttataatcttcttttgaaatgattccttcacggaaatcctcatatagataatctcttaactcccggcatcgcacggcttctttttcttttgcttcttttctaatttccagttcttttatatccaattcttgaaatggtacttcatggataaaatccatgatttttttcatatcaaggatattctcaatatggatttttaccagttccaatactgtttcttctagtttacccattggtattctgtgtgctgcacacgctttcgtagccgcatgtctggaacagatatagtaagcgtatacctttcctcctgccggaacatcccgtttgatcatcattgccccacagtctccacaaaccgcaagtccagataatggatataccttttcctcgttcggagaagtccttgtatctatccctaataatctctgcaccagtgcaaattctcgttctgatacgatagcctcatgatttttttcaattctaacccaatctgtctccggctttttcatcaatttttttactttatggtttggtgttgttctttttccctgcaccagagttccagtgtatacttcattttcaaggattctttttaccgacatggcgctccactctgcctgttcgtgtgttttaaaattatcctgaatccttattccaagactgtgcttatattccattggtgaaagaacaccctgtttgttcaatgcattggcaattgctgtctggctcatacctgataatttcatgcggtaaatttctttgacgatacctgccgcatatgcatctagcaccagtttgtttttattatctgaatctttctggtagccatacggtgtaaacgctccaatatattccccattttttctctttacttccaggtggcttcttattttgatagaaatgtcacggcaatatgcatcgttaatgagattcttgaaaggaatcacgatttcgtctgcctgacttttcccttccaggctgtcataatgatcattgaccgcaataaaccgcacgccaagtgccggaaataatctttcgatatattttccggcatcaatatactcacgtccaaaacgggaaaggtcttttacaacgacacaatccacaattccttttttgatatcttccagcatcatctgaaatgcaggacgttcaaaattagaaccgctgtaaccgtcatccacccgttctgatacaacaactatatcctttttatcttttaggaaattttttatcagatctttctgatttgagatactgttgctttcacgctttccagcagtagcaacatcgccatcttctttcgataaacgaacataaatggctgcatgatagattttctttgaattgttaatttgattcatcttcatcctccttagttttacctttccatcaacattggtaaaacccagagggtgagtcgattttgtcctgatatgaatgaggagtcctgaattcctcgtctccatattaacataactcttcagattttaccatcactttttatacagaaagcaaaagttcctcaaatgcatcttcaaaagatactccattgtttgcaaaccttattttcacttttacatttcctatacagacaagatagggatttcccacctgtctgagatattgagctattcttttttccttcgtctgattccggtcaatccttatttttcggatatccttcaattccttcagatccacatcatcaaaatccgtttccagatagtttctatattcttctgccgtcatgcacttctccttccattcccatctgaatccgtactgctttcagtacccgatccaggatccacttatttactcttccgcatttctcaataatacattttgtggaaatgctcataacctgttcagccagtgccaaacttccttttcggattcccgtcatatcatatttactgataaatacatgtgttggcaaataccgtttcttatatattcttgatgtcagcggaactaccgttatgactgaactgtatgtattggctttattattgctcactacgatcaccggtcttacaccaccctgaacagatgttgtaggaaacataccgagatctgcccataagatatctcctcttcgaatcgtcacttgtcatctctccaatctttttttatttgtaaagcattcatagcgctatattggctccacagggatacggcagagttcctttccaagctggaaagctctgccgcataacctctatagccaatttgattattaaacagtgctcgctcgattctatttatcctcgataccccgaatcgttactcctgcatctgcaggaagggaataataacctgtccggatgctacactccggaccacaacccaaaaactctcatttccaggctctggcagttcataggtttaccagttacagacttctcagggtctgcaagtgtatcgcatctcacacatgtcctcgcatcaccagcctgccaactggctttggtcagtgctttttcgcagcattattagctctaaaaatgtttttacgtcttataatcctatagcggcatcttcctcgtgctcactgtatgaaatgtcacgtcagttattattggatattcagttatcatggtgcaatttagggagtccttaaagctcctctaattactaaagtcaaatgacttcggcagatgcaaaaaattttcaaaattttttaaaaaaattctttcatatacatttcacgcattttattaaggatcgttttcagcttgtacgctaatacttgtctggaaatccccataatctctgccatctgcgtctgagtcttattttcaaagaaaatgccataaataatcatgcgttcctccgcattcagcttatcgatcactttgtgaatatcctgctgttccatttttgtcagtacactgtgctccacatcacagttcaaatccgggaaatcctcaatcatgaatccttctccatcaatagactgtccactgtaaggtacctcccgcagcatcttatccacgacctctcctaattcgttcttaatctcaactttttttgccttgctacttctgtaaaaattgttcatcgcatacgcaacttcttttgtaatctcgatcatttctccatcaatatttgcgtagtactttccttcataaaaatatgggtgttcaatgtacatatccgttcctcctaaatttgaaatcttgttgctcgtttcaaatccagaaggcggacctctgtttagaatcatgcctgctccgcctttatcctgccgggatacgcccgcagttattggctgagaaattcaggcacgaaaaaaagccccagtagttttttcttaactactgaggctttcgtctctttcttgtattcagttatctatgccttctttcatcagcataatcattgtatcaggataaagttcacaaagtatccgcaatatgttcccataagttcatatcattattggaatcgtacatatttcagtataaaaagttcaccgtgttattcttctacttcttttccatctatatatagttgaaatttatcaggattattgactacatcatagtcctttccatattctacaggtctgtattcggctgtcattaccgattccccatcttcaatatcctctttccataaatagatgttcatatcaagactcgtcgcatatcccctgtctgtggagaattttgtcgaataaaaagaatcatccttgtacatctgcaaaagctctcttacaaacgcttctctatcctcaatatttttccggttagcaaccacggttaaattttcatcccgatttacggaaaatgttccaactacatccggttcgccttccttatgaccagattcagatttcccataaatacttcctgcagcaattatcaagatcactgctcctgaaatcaatgcaattatctttttcttcatatttttattttccttttagtttttttactgcgtaattgattacttcttccggtgtaggtctttctcctttaagtgtcattttcttccattcttcctgcacagccggatcaggattatcaaatcctgcatctatggctatctgcatttctctgcgtacttcttctggtgttgtgttgtacttttctgcaatcttctcataaatagttttttctctcattcattttcctccgatatataactggatttacaacttgttctatagaaccaatttagcatatttctattatcatgaaaagacactttacaacttaaatctgaataaatggtcaaaaaaagaagagctacttgctcttcccagtttgtcatatcactcttccaataatgtgtgaattactttgatgatttttttctgttctttgattggaagtttttcaattttttctgtcagttcatttgtaacacctgtaactgaatgtgccacaacatcaattaaaagagtatctgcagaaacatctaacgcatttgcaattgcaacaaaggtatccaattttgtaactttcaagcctctctctattacactcacatgcgtcgggcttaaatttactaatgcagccagttcctcttgtgtgagattttttgcttctcgtgccgatttgattcgctgtcctactgctttcaaatccatcgtaacacctcctccggaacgaataatcgttctggatttagtatacttgtggatgtcttcaatatacagaatcgcaaaaccaagttctaattctatagaactatatttcaagattttctttgcattttcgtaaaaaagcgttatgattgaatcagttaaatcaaaggaggtatcaaatcatgaaatcacataaatactggtccttaggcgcacttttctgtatgttgggatgcatttattctggaatcaaaaaatctatgactgcacataaatactttgcctattcttcattgctttgtattggcatgtccatttattccggtcacaaactggtttctccaaagaagaaaaaaatcactgaatcaaataatagtgagaatagttaaatgaaaatttgacctttattcatcaaagacaaagttgctggagaatattttttctctccagcaactttctttatctttaagccattgaaatacaatactgtccaatcagcttcgtccaactattatatttattcttttcacacacctttcggcaaatttcattttccatcaatacacagaacatcttatcataatcaaatgcccaaacagcaccattcacatggttttccactgctttctgatctatgctctttaagcgtgtgaccattttttcaatttctccatttcccaagttaccgatatttttgcagataaaccgaaagaaattcaacgttgcatattcgtcatgccaatggaactcttctggattgtttttaattttactggctcgttgctgttctttgattatctgatcagctacacctttcatcgaatcttcgtatctcatattattcacctactcttcctctacgcccagtgacggtttaaatcttttatcctttgcctgcggtaccacgatctcataaaaataaaatcctaaatacccaagtgcctgcttcttcattttataaaatgaagtcctgcctattcctaactcctgttgtacttccacatctgtcttattataatgactgcaaaaacaggaatgaaggatctcactgagcatcacaccattcggtgcatagaacttaaccagtgtcattccacgatagatcatatctgacaagccataaatgatcatcaggttattcatttcccggtgcatctttggcacattcagctgattgttataaatgctcagataactcaacgcatatgccatatcttcattgattttctcctggcactccatatccagttcttctaacacaatctgattttccaaaatcaatttctgatagcttgtcatcaattctttaatatcagtataatgtctttcaatcgttacttccaaataatcctgtgcatggcttgccatctggaaggtaatctctttcattgatttaattgcataatctctgtctgtcatcagtttcaaaatctccttatcatcatcacactaactggcggtctttcagaccagttcgctttccccatgattttgatgggaagcaattacttactacaacttgcagaagcggatatccaaaaggcattgtgggagctgcctttgctgaccggaatccatcttcttatgtaaaacctgcaggaataaaaagggaaagtgactatccctgccggttaataatccaaataatatcgtctataccaagctctccttatgctgtttttctctccataaaccatttatccacttcgtaaaacaagtggctttcctgcccttgtatcatacaggtgtacatcattcctacaccgcctgcctttctgctggcgcatcgctcgattttcaaaattctgtcaatgctatactttcttccatcctcccatgtaaaaaatatgggaaccagctgtccgtttttccgaaactctgctactacatctacatatactttgttcatgccgacacctcactataaaatctcaattgctcttggcgatgccgggattctgcggatatatccatttaactccaactgcttgattctggaaaatgctgatgatgttgatttcaccccgatcaattttccaaattcccgtattgtcggtggatatccatgttcattggtatatcgtaaaatacactgataactttcttcctgttttctggttaatgcttttttcaaatctatccctccaattacccatggaaataactatgtggatggatcgtgtgcgtaccagcgtctaagtgggataagactttatcctgatacattgccgctcgctgtatactgaaataaccaaaccgtcgtctgatctcatctacagtacgatccagcttctctaacttttcctttttctcctgatttccaaataaatccaactgcacgggaatatcatctaacacaagatccgcagctcggattcccaggcttctaatgggatgttcccatttgtaattatctttaaatagctgaaatgctgcagttacaatctcgtttgtaatattcgttggctgtcgtaaatgtatctgtctggaaaaactatacaatcgattatctcgaactgtaatttctatcgttttgcatttaaaaccatgttttcttaatcttgctgcaacgctttctgccagtgccatctgaatgatccagacatccagatcatcttctaaatctcttggagttgtggtactattaccaattgacttcaccggagctgtatacccatctttgcaaactggatcatcgtcccagccatttgcaaatgaccataacacaattcccatctttccaaaatggctttctaacattgcttcatcactttctgcaagttccccaatggttcgaatccccagcttctgaagtttcttccgagtctgtcttccaacataaagcagatccgatgcaggaagctgccaaatcatacttttataattctcccggttaaactctgtaatcgcatctggctttttgtaatctgaaccaagtttcgcataaatcttattccaggaaattccaatacttaccgttacacccagttcgtatttaatccgatggctgatttctcttgcaatcgtcattccgcttcctttcagatttctgctgtccgatacatccagccaggcttcatcaattccatatggctcaatcttgtccgtatactccgaatagatttctcttgccatctttgaaaatctcaaatacaaatccatccgtggtggtacaaatatgatttccggacaaatctgttttgcctgccataatgccattccggtctttacacctttttgctttgcaatataatttgctgtcagcacaatcccatgtctggcttccggatcgccaccgactgccagcggcattccggcaaattccggatgatgcagcatttctacactggcataaaaacagttcatatcactatgcaggatcacacgctcactcaaacttttcacctcccagctgtttccttcaacatgatgtcttatcaatttttgtatgtttagtatatatcgacattccggagatagtcaagtaacatcttggttgtattttctccattttggagattattgttgattttatttctaacatacggtataatgcatatagaaaattcaaatagaaatgaggcgaacaaatgcgtgatttcggggaaatattagcagaaaatagaaaaaagaaaggatactctcaatcagatctggtagacctgctttctcaggaaggtattcaggtcactacaaaagcaatctccaaatgggagaccaatgcacgagaaccagctttacatgttttcctgacactttgccagttacttgatatcgaagatatatatgaatccttctttggagaaaacccatataacattatgagtggattgaatgaagaaggcagaaataaattgattgaatttgctgatattttgaaagcttctaaaaagttttctccactgtctgcaaaaattatcccattccatcatcctgtagaaattacctgggaaccagtttctgctggtactggaaattacctggaggattctgtaaaagaaacctatgatgtaggacaccttgctcctgagcagactgactttggtgtacggatttccggtgacagtatggagccactttatcatacagacgatgttgcatggattcagaaaaaagattctcttgctaatggtgaaattggaatcttctatctcaacggcaatacttacatcaaggaattacacgatgagccagatggtgtttatctgatttctttaaatcaaaaatatcgtcctatccaggttttggaatctgactcttttaagatttttggaaaagtaatcgggaaatgcaaaggtgcagaaattccgggatttcattagacttcaacagcaggttcatgatcctgctgataacaataagcaaaggaagtgattgaatggcaatcaataatacactaaaagatattcgtgaagaacggaatctcattcaagcagatttggctgaagccataggttcctgcagccagactataggccgcatcgaacgtggagaacgtaatccctctcttgagattgcaatccggctggcacattacctgaaagtgcctgtagaagatatttttcaggttgaagactgaaacacagctgccagaaaaccgaggagtaaaatccccggttttccttttgctcaaaaatcagtgtaatccttttacgaaatccgctgcgtttttcatatcttcttcattcggatggtctttagcaatacctccaaccagtttaaatggtccgaatgtgtcataccctttacaaccaaattttccaaccacactggcatgtcttttatccaaaatctgctctatggttttataattcgcactcccgccataagtacagatcagaaatatctttttgtcgtccggtagattcttctctgcaaattccaatatcgactgatgaaactttgaaaaatagattcctgatgcaaacccaatcatatcataactgctcaggtctgcatctggctgtttcacagcatcaatcaaatccacctgacattcttctgcgatcctctttactaatttttctgtatttccatgatgcacagatgcgtatactatcgctgttctcatttttcttcctttccgtctgctccgtcaatcaggtcatagctcatatccaaaaagtccaatatcttcgcttcactgactgaaccatccagtaaaatcgtgatccagtgctgtttatccatatggtatcctggtaaaaatccataagtctgaataatcatgctggtcatttctggattgcactttacatccataatgtcaaccagatcatttccctctaatcccagtttcgatttttcaaccgtcatgatcactgcataccattttccatttttatgtcgaagtactgcactgtccgatagtttactccataaatattccggcattgtgccatactgtttctgcacatattcaaaaatttcttctttcttcacaatctattcaactcctgatttttctgatatcctgcccataatcataccacattttcgtatcccatactacctgccaaattcttttgcatttttccggttctcctgactttaactaatagaggggtaaaacagcaaggacaggaagtgaggatacacttccggaaaatcccaatttagggtaccctgccctaaattgaaaaaacgctgaaagcaacgatactactgccctctcagaaaggagaacccaccaatggctgaaagaaagagaaacaaagaaattcatttttatgtcaccgaagaagaaaggaagctaatccgcaggaagatgatagaatcaaaaaccaaaaacatgggagcttatctgcgaaaaatggcaatcgacggttatatcgtcaacaccgataccactccactgaagaaacagtatgaggaaatgcacaagattggtgtaaatataaaccagattgcaaaaaaggtaaatatcaccggagatctatatccggaagaaatgcaagaattgaaagagatggtgaaagaattatggcgtatcttaagatcttccccgttaaagtaacagacaagaaagctctggactacatcacgaatccagataaaacagatgaaaaactgttagtttccagttttggctgttccccggaaactgcagatcttgaattttctatgacaagagaaatggcaaaaaagaatggaatggacaaaggtgataacctggcatttcatctgatccagtccttcaagcctggagaagttgatgccgaaaccgctcatcgcttagggcaacaatttgcagacgaagtactgaaaggaaaatatgaatacgtgatcagtactcatgttgacaaaaatcatattcacaatcacatcctcttcaacgctgcaagctttgttgatcatcacaagtatgtttccaataaacggagctaccacaaactttgtagaatcagcaatcgtatctgtcatgaaaatggacttgccaccagtatgccaaccggagaaaaaggtaaaaactataaagagaacatggaatatcatcgtggcaccagttggaaagccaagctacgtgttgcggttgataaggcaatctgggtttccatcaactatgaggaatttctgcaaaagatgcagttagccggatatgaaatccgccaaggaaagcacctgtccttccgtgcaccagagcagaaaaacttcacttatatgaaatctctcggaagctattattccgaagaaaatgttcgcatccgcctggcaaaaaatcgtagcaaagtaaaagctccaaagcatctgtccagagaagcccgcctgtatatcaatatctccacgtatgttacaaccggcaatcgagaaggatttgaacgatgggcaaagctcaataatttgaaagaggcggcccgcaccttcaactatctttccgaaaataacttgctgaattatgacgatttcaggcagcatgtatctgacattgaagcttctgtgaaagttgccgaccaaagaatagcacaaatcaacagtgaactgagcacgcagaaagtcattcagaaacactgtgattcttatcggctttgccgtaaagtaattgaagattgtaaatctgctaaaaatccaaaagcataccgcaccaaacatcaggcagaataccagctccacgattcactaaaaaaagagcttcaggatctcggcgttaccaaaatcccaagccctaataaagtccaaaagctgattgaaaatcttgaatctgaacaggctgctactgtccgggaaaaacaggaattgcagaaaaagcagaaaaccttggaaatcattcagcaaaatttctctgtgctgctcgatgctccggaaatcaattcagacttacttccggcaaaacgggaatccgtttctgtcacaagaggtcaataagattgcactgcaactcactcattttcttcccaaggtttcagacccatttcctcccaggtgacaccatacggtgcacctccggaggtataaccggcaataaagaaaaatctgtcatcttgcaagatttcttctttagccagattatctcttgtttcttttttctgtcttgctcgcctctgctgcttcttttgtttcgcaaaagctgcttttccctgatatgctttcgtgtactccatacagtagaacgcagcctgccggtctgcggcaagctgcgctcccgcagcgatgtttccatcgaccagtcctccccgcattaggttcagcaccgcacggagcacgacgggaaagagtgttgctttttcccccttatcgccttgttgtagcaggaacagtcctcttccttcgttgaataccgcacgcctccatctatcgccctgtcaaaaggtgccggcagatccatcccaatctgccagctgtcaaataatctggtatttgccatacgtttctgtttcctccaatcttttatttcctacaatcccttgtaattctttcggccgcttctttgaaaaatctctcttccaggttccttaccgtacaatacaattcgggtaaaaggtatttgggttctccacttttccacattccaatccattatataaatatattcgatcaaaggttgttcttgtcttccctccttttgccagcctgaacataaaaaaagacaccaaaaaacaattctttgctttttgatgtcttttctgtcttttcaggctgatgcccgaatcaatattacagaagtccgaacagacttctcctgtacttttcgcacaatctactttcaaatcccggacctctccagaatgaaatttcttattcaggatatttcccaaataaaactatttacgcaattatcatagcactgtattttgtttgcgtcaacatttcaatcacaatatatagataatatctgttgattagatgcaaatttctgtgctaaataattcattcaagttatgctgtatcattgctctgtttttcaaccgaagctttcaatttctgaaaagtctcttcgctgattgcatgttctatccgacaggcatccctttctgcggtttcccgatcaaccccgacagctacaagctgctccgtaaagaactgatgccgttcataaattttctcagcaacctcccgcccgtcttcggtcagatggagatatccatcttcatccacggtcagaaaaccgccattctttaacacacctactgcatggctgatactcggtttactgaatcccatgtgtcgggcaaggtcaacggagcgaaccatgcctttttccttttgcaatacaaggactgcttccaaataatcctcgcccgacgcataaatcttcattgccgcctcctttactgtgccagtttccagccgatagcttcctgcctttcggatacgaagtccgcatacagacccttctgctggatcagttctgcatgagtgccgcgctgaacgatatgggaatcatccaataccaatatctgatccgcaccccggacggttttcagacggtgggcgatcataataatagtcttgtcgtgcgtcaattccgcaatcgcccgctgcaattcttcttcattttccgggtcaacgctgcttgtggcttcatccagaatgataatcggggcgtctttcaatatggcgcgggcaatggaaatacgctgcttctcaccaccggacagggttcctccgccttccccgatcaccgtatcatacccgtcggtcagggcggaaataaattcatggcagcaagcctttttcgccgcctctaccacctgttcgtgcgtggcatccgggcagccgaatttgatgttgttctcaatcgaatcggcaaacagatacacgttctgaaataccatgccgatattcttcatcaggctgtccagtttaaaatcccggacatctttgccgccaaccgtaattctcccggcgtctacatcccaaaatcgggcaatcaggttgcacatagtcgtcttgccagaaccggacgggccgacaatggcagtggtcgttccggcagggatcgtaaagctgacatgatccagaatttttcggtctgcataggaaaagtccacattatcaaatataatttccgaggatgccggaaccacatctgcgcccttttcatccatgaccggcgtatcgtcaatagagtttgccgtatccatagaagccgccagcatttgcagcagggaggccatgtttccggcgttttccagatcattgaacaccataaaggaagcgatcaccaaaatcacgccataggccaatgacagggaaccgttcagccagaagtaaatggaggccaggagcagcaaaacactgaacacccggacaacaacctgtttcagggcatcataggggacactggcttttgtcagtttcaaattgtcccggcagcttgccttgattgcgctgtcaatggactgtgtgctgtccttctccataccgaaggctttcacgatccccatcccctggatatactccaggacggattccacaaggctttcctgtgtatgctgccgcactccgcttaagcgctcagatttgcggagcgccagttccgccgctgcaagataaagcaggacgccgactgcggcaatcagaccgatccgccagtcaaaaaccaccaaaacgatgacaagcgccaccgaattgaaaaatccgcccaacacagataccagcacacgcgccgccgaattttccacatcccctaacgtggtggtaacgatagcggtaatgttcccgatactgttcttgttaaaatatcccatcgggatgtaacgcagccggtctccgatgtggatacgcttttccgccaccatacagtagccggtttccgtctgctccatcgtggagaaataggtcgtgatgatccttccaaccagggaaacagccatgatgcccaaagaaatccagataaaccggctgtcccggttatcggataccaacgcctccaccacgataaagagggcggcaaactgtaaagccgcaaacaggccggagaggaacgcaaacagcagggattttttcagcagtccctctttgctgccagcaaacgcaaaaatttttttcaatgttccatacatttgacaacacccccttacatatgatcctttgcgccgatatgcgcctgccacatatcccggtaaaggggacaggtttccagtaacttatcatgcgttccccgggcatggatagttccatccttgaccaccacaatattgtccgcaccgataatggtagacaggcgatgggcaatcacgatcagcgttttacccactgtcagggcagagattgctttctgcacaactgcctcattctctggatcgatatatgctgtcgcctcgtccaaaatgaccacaggggcgtccttcagcatggcgcgggcaatggcgattctctgtcgctcaccgccggaaagatgggaaccggcgctgccgacaacggtatcatacccttgatccaacttgcggataaaggtgttacagccactttgttttgctgcctgctccacctccgcatctgtggcgtccggcctgcccatgcggatattttcccggatgctgcggttaaacaggtaattatcctgcgatacataggaaatctgggcgacaatttcagacagcggtatctccttcagttcatggccgcccagggtaatactaccggacgtaacatcccaatacccagcgatcagcttcgccacggtagattttccggaaccggacggtcctacaagggcggtcatggttcccggctgaatggaaaggctcacatcatgcagcacctcagtttccccatcataggaaaaggaaacatggtcgagtccgatactggtatctgccagatttactggcgtatctttatggttcagttcttccgcgttcaatagctggctgatttcctccacattggttcccagtacagccaggtcatccgtaaaggtaaagacggacatgatcggtcccacaagccccagggagaaaatcacaatggagaggaacgcagataattccaggctgtcggacagccagaaggcaaacccacagggcagcacacagatcagcactgagggaaggatcgcattgtaggcactcatggttttctggttttcccgcatccattccacatagtaattcgcattgtaattcacggcgtccgaatatttcttgtaggaaccggctgactggctgaacgccttgacgacttcaatcccgccgatatattccacaatggcattcgccatatcttttccggctttgaccgcaccctcccatttctttgggtaactcatcataccgacagacattacggcaagaccgactaccagcgtaacaagggacaacagcgccatgcgccagtccataatgaaaagatacacgacaattaccaccggaaccaggatgtttgcggtcatctccgggatgagatgtgcaaacgtggattccatcccttctacccggtcaacaatcgttgttttatactgaccggacggagtatccaggatcgttcccatcggaacgcgggccagtttccctgtcagcctctcccggatatcccgcagcgtgtaataggccgctgtatgggaaatagtcgttgacagactggaaaacagcactttccccaggtagccgcaaagtgcgaccatgcaagctgtcacataacgggaaaaatcctgctccccgtccaacatcattgtgacgatatgcgccacacagaaataaggcaccatctgacaagcaacacccaaaaccgcaaggacgacactgccgatgaattttccgtgatacggtttgccccatcccaataaaacacttattggcgacgctttcttttcttccttcatttttcagataccccctttatgaagtattctcttatttttctgaggccatcttcatccattccgtactggtcaataatcgaaccatcctcaaaatgaatgatgtccgtacagcaatctaaaatcagttccaggtcatgggtaatgacatacacagtgattccggcatccctgacctgccgtaatacatttgcaacctctttcatatgcctgtaatcaaggccgctggtcggttcatcaaaaaacaggatcgagcgttttgaagcgattaccgaagcaatcgcaaccctttgtttctggccaccggacagggacatgggatgcctgtccttaaaatccagtaaatctaaccgacttaggatttcttctgcccgcttctggtttgcttcctccatactgatcagcacttcatcaaggaccgactcggtgaaaagctgatgatttacctcctgcatgaccatatagcaggtattcagccggtctttcggacggtatttctttccgttccagacaatctccccacagcgcttctccaagccacagaaacagcgtgaaaaagtggatttcccggcgccgttattcccgataattccaacgatccggttcgtagggatttcacaatccatgatatgtaaggtttccggttcgtttttataggcaaagtggaaattacgaagcgcaagggcggtcttttcctgctgcggtaaaaccggaggcaggagacgctccaaagcaaacgtgcgcagtcccatatcggaacgctgctgctccgtgagctgctcaaattctgccgcagaataatcatgactcacctgcccgtctgccagatagataaaccgatccgctagaccgcgaagataataaagtcgatgttccgatacaatgattgttttcccctgcgatttccaaaacgcaagaatctttctcaaatcaaggatggaagccgcatccaggttagatgagggttcgtccataacgagaacatccggttccataatggataccccggcacaggcaatcttttgtttctccccgccagataagtggaagatattacgatccatcagcttctccagccggaagtcccgaaccgtttttgccaaccgttcccggatgtctttttctggctgtccaagattttcgcagccaaatgtaatttcactggtggtatccacattgaaaaactgggaccggggattttgaaacacgctgcccacaactgcagctgtatcgtaaaggggctgttcggaaaccttggctccatttacccatacttctcccgtcatctttccctcataataatgtgggatcagtccattaatcaggcgggtgaccgtagtttttccacacccactttcaccgcaaaggacaacaaactgaccatcctctatatttagatcaatatcccgaacaccgccggtattttcattctcttctccataagaaaatgaaatatggtcaatctttatcataagctcacccccttaaaaagaaaaatactgtcccagcaaaaacagagcgaaacatatagcacagagcaggatcgcaatcatgtcctgaacatgaaaaccaatctgacatacgttagtccgtttgaccggagcgccaagcccccgcgtcagtgcagcggcggaaagttcatctccaattttcacaacagacaccatcagcggtacaagacggtattccaccatcaaaaatggatttttccctccaaaccggatacccctcattttcattgcatcactgattgcctggtattcttcgctgatcgtagggaaaaagcgaaaaataacagacaaagggatgacgattttctctgtcaggtgcatacgttccatcgaaccgataaactcactgactgaggtggaggaaagcagccaggcccccgtcataataccaggggcaaaccgcgtcataatggatgtcatcgccaaaaccacaaaggacagcagatcgcttaatgtcgtcagcgctatgcgttccagtgcaaagcaggcgagatataaaagcaggtacttgcctgccgttttgaaacggcgttccgacaggatcagcacaaatgggattaggcttaacacaggttttacaaaattcataatcccttcgttgctggtgctgaacatcaatgtagtaaccgtcaacagcaaaatcaacttcgtacgcgggtcgagccggattcctttccttttgtccgttgtggcggaaaaggataccccctccattatgcgatgcccgctttcgcaaaatgttttttcagaagcgtttttccaagcagtccgcccaaaatggcaaagacaaaaatcccggcaaccacaaggataatgctccacatcggcataaccgccattacccgatcggcatatttttccccgaagctggcggcaaagcttgcccaggagtcctcgaccataaaatacatcggaatatatgtacctaccatccacaggctaaatacagcataaccaaggatgcttttctttgcgcttttatagtcgccggatttcaaaatgagatccccaagcaggccgaaaatcagtcccataggaacaccccaaaaccccatgccggtaagtcccatcagcagaccgctcaaaacacccatgattgtaaccatgccaaatttcttaacccttgtgaggaacagcataaaagggataccggtaatcagcgaccacaggcttccgagaacaggaagaaagatcgggacaaacccaatcggaatggcgacacagcagccaatgacaaagtaaagaaccgtgaacagaccaaggttaatgaggtcttttgcttgtaacttgttattcatgatgaatacctccacattcattttccagttagcatcttctaacctttttttatagaatagcatagtaccggctgattctctacaaccaatcatctttttagctccaaacagcaccgagtttttctgttgactgactttgactgtgatcttataatagaagtgcaaggctcaaacagagcggttaacagaccaaatgacaggagttagaaaatgaagatagatgaaattatcaagaaaagcattgaaattccaggtatatctataaaacgaggcgaatttagcgcagaactcattctaaaggagagagacgggaaaggttccatgacttttttccctctgttcccaggagttacattggcttatatttttgtgaactctcctgcctggacagccccagactttcacgataatggctccatggaaacaggaccattactcttaaattactgtgtaacagggcgatgcgaactcatcctgaataacgggaactttgtgtatgtgaaagatggggagatatccttaaccgaacgattcgccagacagcaatacgtttatccccgccgaatctatgaaggaattgagttttttgtggatatggataccgtaaatgctcaaagctcctgggtagaggctgaatttgatattgatttccacagactcagagatctttactgcccggatgggggtacttatattgcgtcggttacgactgagatagaagaagtcttaaaaaagctgtggtcattactggatatttctgttccgctggcaatcccacaaatgaaaatctatacccttgccctgttttcactgcttcaaaatctgaaagaaataccaccttcccaatcctgcacattcttcacagaaacacaggtagacattgcaaaacgtgtggaaaaaatcatcacttctgatctgcgccaacaccatcctgcgtgggaactggctgcacagttttccgtcagtgaaaccagcctgaagaactactttcgcggagtttatggtcaaaatatatcaatttatttacgtgaaattcgtatgcaacgagctgctgaattactcactactacaaacttatctgtatcggaaattgcagaacaagttggttatttgaatcaaagcaagttttcttcggcatttaagaagcagttcaacgcttcgccattagaatttaagcgccgcaaaaatttagagagaaatacttccaactgacgggttctaacatttttcacaataaatatttttattagaaactcatgacaaatgaagtcagagtcatttcttatattataggaagtgactctgattattataatttataaaagtacctataaattttgcataagctttaatcaattattccttcttcaatagtttcttctttccattgctctttattcttaatatacgcataatatttatatataagttcatatgtcatgggtttaatttctagattcattttttttaattcagagcgtaagttttctgttgaaaattctatctgtctttcttgtttccaatatttatcatcaaaaaaatcaagaaataacgttataggcaaatcatctctattattcgcaatttctatccattcgtttttttctaaaggttgcaagcaaatccctatcctatctacaatatctacagcatcttgaaagctaatctctttcgtatttataacatgatatgtcttgccatattgatcttctatttgggatattcctaccacgattttcgcgacatcatctatcgcaatcggcgctatgcttcctttaatatcaggatatactcctagaattaaacaactttttattattctaaaaataaagtctccatcattacatactcctgtttccgaatccccaacaacatgccccaatctgtaaaccattacagggattccacattcttttgctttccatatcagtccctctgcaacccatttactttgtgtataaccaataggtaaaatacccggatcagaaatatcatcattttccataattatattatcgtttgttctaaattttgaaaaaattgatattgtggaaatataaaatattgcttttattttcttatatcctgcaaaccgtattatttcttttgttccatttacatttatattctttaattcatagtaatcgctcaaaaaatgtacctttgctccattatgataaatacaatcaactttttcagctaatttctcataaacatccatgtccattcccagattaggttctcccaaatcgcctaaaacgatatgaactcttgcttcttcataaagtgacatattaattttatttaatactccttctaatctgtcctgtgcagcttccattgatttcgcccttatcaagcaatatatttccatattagtttgccttaatatttctttcaacagatagtttcctaaatttcctgttgctcccgtcaatagacatacttctttttttattggcacactctttccttttaaatctatatccaattttacttccatctctaattcttttgatgtcaaccctgcttttaagcaaccatttaaaatttcatatatggcattacttagtttttctactgtaggataagaaaaaatatatgaaaatggtatatctatggaattatcaaataatttttttatttccccaactatccgaattgcatttaaactatttcctcctatcagaaaataattttcatttattttcaaatcctttcccagttcttcgctccatattttttttatttcatcttgtaattcatatacagtatacttgttttttctcatatggcttttattgtttctcctactattatcattatatgttctacataaataatccttaatttaaagccccttaatacaaattggcggaaatttatcgggataaatatcatgtgtaggtcctatacatgtgccaatatcattccataacttacataaattcaattggtattgtataaactgtcgatcacatttttctttaattatagtaataaattcatcaaaggcattggctattccctccggccatatattctcatatatgtcttgatatgtgtattgaaggcattcttcgtttaacacttcacttactttttgttttgaatactcattgtctccaaacagctctagtatattatctttcttagggataaaatatcgcggttcccacagtacagctcctatggaattatccataactaattgaccgctttttgtaaaaactacgattctatgaaataataatgcataattgtctgagtcttgcgaaaccattctattttcaactttcaatatcaacggaatttcgtttatgctcccttccagtattgttaatattccatttttttctcctgtcttatatactttacatggtgtaatccctcccaacattttccctataatgtccaaaagaggatacaatacttgtatactacattctgcttctactaaaatcggatccgctaaatgaagaattttatttgcatatctaatagctgccataccagacggtagctttgaataaaaattattaatataataatggcatttattcgctattgctattgcatacaattccttcgcatctgtaaaatgaactggttgctcttgaatcacgtttattcctttttttaaacactctttagcaatttccgttccttttccaccagtaatagatgattttacagccacacatacaatatctacttcactgctacttatttgtgaaacatttgtatataatggaacgccattactttctgcacactttctagattgttgactcccttttgataatatcccaaccaacttacattttgtagtttttcttgtgataccttctatatatattcttccaaagtttgtcccacaaactataacccgataaaatttattttccatatttaatttcatcctatctactttgtttaatataattcataatcttaatcaaagagaataaagtaaacatctatagttgtatttactttattctcttttttgtttattttattaacttggccacttcacgcacatatggttctttaagacagctaatatgttcccctggaatataatctacagttaattgtcctaacacaatgttttcccacaaacttttattggtaatatttctaacagggaaaaaatgcttcgtatcatcttccacaaacattgcttgtacatctcctacatataccgaaggttcatagtgcatgattcctttgaaactgtgtcgaaacagaagaaacaacattttaaacatacttacattatccgcatcaattttctcatcaccagaaacattctcatatattttttttagcctttcttcttgtgataatttatttaattttctaaaactcatgcccaaaatttcatattctccatgtaatgcacatagatctcctatcgatatacctttatccccattttcctctttgtatgtctctagtgctttttgtagcaaatcattactccccaaatatccggctttttctatatccgctcctatagacagtccaaatgccctttcaagaagcagttcattatcataattatgaccgcacagacttgagctgattgtaattactctgcttacatttttccctttctcaaccagaattcttgccgtttccaaagccaaccatccgccaacacaataaccaattaaaatatactcttctgctggatgctcttctaaaatgtctgcatatactttcgcagtttcgatgatcaaactatccgtatctctctccaaatatttatcaaaactcccaaaattgaagccacatagcagatcacaaggagcactgatatttgctaaatatggaagaagttctttataggaacttaatgttcctgttccagcatgaaaaagtactcttgcctttttacaatctccctccgcatctttgaacgtaataaatggagaaatttctgggacattctcctttttttcactttttgtcacaaaattattttgtaatttttcggcaattcctcttatagttgcatttttcatcatctccatcattaaagcatcccatttccagttttttgcttccggtaagttttgaatcattttactaatcgcttgtgcaatgagtaatgaatcaccacctatcgaatagaaatcatcatttcgtcctatgttctgacaaccgataacttcacaccatattctctcaattcgcttttccaagtcatcaatgcattcttcttttttctctgtttgattagaattgtttttttgtaaatacaattttttcctatcaattttgccattattagtcattggcaactctcttaactgaactattctattcggaatcatatatgtaggaattttcccttttaaatattcttttatttctcttatatttaattcactttccgacgaaaattgaattcccatcaatacttgtccagcaggatataaaatgtcgtttttttcaggatatgacataaaaatattaccctccatagttttgataatgcgttgccactcatcaaaatttataaatatactttcacttattttacgcccatcctcatatttaacagccgcttctgcgaactcaaactccacagatgtcatcagtgcatatctttttcttacttcttctataataaataaactaccttcattatgaagcatttcttttagattattgagactttttttaatatcaacagcattatgcaaaacatttccacataatataatatcaaatttctcattttcaaatccttgttcccaattcgatttattaatatcatagattttgtatcgaatccaatcattatattgtgaaaaaatcacttttgccttattgaaaaagaaattagatatatctgtaaaataatattctacattacatgactgtattttacttaataattctatgctactacctccaactccagctccaacctccaaaattcttattttctttttcttttgctgttttataatctctaatacttcgttgtgaagtattctgttaatagatctattaacaatattatctttatatgcagcatatgctatatcaaaatttccttgagggaacaacaactcattcggatgcattactcctgtaattaactctttgagatgcatggaggactcatgtatatactccatcaatacgtcactatattgaatcttcttatctactaatttccactcttcctctgctttttctgcaatattagtactatatatctcttcaatataaaatccttctttatccaaatgaagatatttgttttcttttaaagccatcaaccatcgcataagtagctgctcatatttcggtattacatttaaaatacctttaatttgttcgaaggagtatcgcttttcaacatcctcaaatactttttcatttaccaaaaagcgtaagatatacatcaaggctgttttatctgctttttcaatccattcttgaaattcctttcttgtaaattgaaatttaaattctttctcctcatcaattatttttttctctattacctttttttcttgcttgcctttatttcctagaatgtaagcagttaaactaccctcattactttttacaactactgcattttctattcccgggtatctctttaatgcattttctatttcgcctaactccactctgtatccattaatttttacttgtgtatcttttcttcctacaaattcaattaccccatcttccctatataaacccaaatcacccgttttatatactctttcctcaatttcagtaataaattgaaatttttgatctgagagagttacatcattcatatatcctttcgcaagactctttccagctatacaaatctctcctataacataatcaaggcaaggcaaattcttttcattcaaaatataaaatctttgattagataaaggaattccataaggtatatttttatccgtactttttactctatccgttggataatatatggaccaaatgcccccttccgtagctccgcccaaactaatacattgaacatttggcattttttgatgaattttttcaactaatttaactggaatccaatcccctgatagcaaaattaagcgcaatgtatccagcttgtactcggtagtctgtaaataagccatatacatttccatttgcgccggaaccaaattaagcactgttacaccatgttcctgacatagtttaaaccaaaaggaaactttttccttttctgtttctgatggtaaaatcaatgttgccccaacaaaaaatgtcgcaaaaatatcaaatacagataaatcaaagtataaatttgaaattccgaatattctatctttctctgaaatattaaatttcttgcacatatccataattgtattcatcgctgcggcatgactcatctctactccttttggaattcctgtacttccagatgtaaaaatacagtatgccgttgactgtggatcaatatacttatattttatatcccatacgttgttaagcatttccgcatttagcaatatacttttttcatctttccagcatgtttgttcatcacatatattcaattttatattagcttgaatcattatttgttgtatccgttcagctggttgcgtaatatcaattggcacatatactgctccaactgacattaccgcaaccactgacgcaacttgccatacacctttttcaagcaaaatgcctattttatcctcttcctctacatttttttctattaatcgctgttgaattgcacttacatattttagaagatcgctatatgaatatttctctttctgataaataagcgcagtattataaggtgtattcctacatctcgtaaaaaaaccatcaactaaagatttctcatcaaaaggggtattggtatcattaactcttgcccgtatttcttttgttctatcgcttatccctacttctaaatttttttcaaaaaaatcctcgtcgcttatgcttttattaattagctggatgaatgatgcaaacatttcatcaattaatccttttggaaataccccatctcttatatcccaattaatcaatattccatttatttgtttactgatttggcaatctataataacctgaggcgtttcacttattttatataataattgtctcttacttaatgtgctgtcttcactttcgccccctattgtacttgtaaaaacatacgggaaaagattttcttttccttttctttttagttcccgcaaaactgctattccagtaaagctatcatgtgctaaattttcaaataaattgctttgtaccttctctacttgtgcgtttacttttccctcaaacgttccatcgaattcaaataacgatgttgttgtaaaatcccctactattctctgaatatcctcatgaatacttggtcgttgtagggttgtaatattaactgtaaattgactatttcttgaccaattgtttaatgttgcacaatacaaatacaaaagcaatgctgtcggagtaaaatttaatttctcacatttactcaccaaatattgccactttttaggatcaactgtatattctttacatatgaaagttcctttccttataatctccggttcctctcttgtatacagctccggttttccaggaaaaacatcaaccttattcagccaatatttttcatcctcataatatttgattaaaaaatttatatcctctttctgattctgattatatattatataatctctgaaattcagtgttagcttttccattttttgattattgtacaatttctccaaatcactaataatcaaatctatactaacaaaatctccaattaacatatccaatgacaagcataaaatgctcgcattgtcatggatgaacagacataaatcaaacaaaatatccttctctggatcatattgtttaaattgcatttcttccctcttggcaagtattttatgttttattttttctttctcccagcctcttatatcgtaaatttggacaggtgcattaaatatgtatggtaaaaatctttgctcgccttctttcgaaaattgaactcttagcatttcatgtctttcaataagtttttttacagcatctcgaaaaataatctcatctgtaaattcagttaaaaactcagcataaactttacaacctattccaccataaagatacccctgatttcttccaagcagatatgctgtctgaatatctgtaagcggaaatggcttgtatttttgatcttcgctagattgaattttttttctctcttttctgtttaagtattctataattgcgtctttatttacttttatattttgttttagtttttcatcgaaaacgccgactggacttctaaaatgcaatttcccattttcaatccataattgtatttttcttttagcgcattcttcaataatactttttagttccatcttttcaccctgccttaataattttcaaacacaataaattttatctacccttccgatttccaaattattttgcaattatcttttataatattccttcattatagtcctccgtcttttctataattctctttgccaattttcttacactcgcattttcatacaaatcttttatcgttattacaatattatatttttcatttatcttccttattagtttcaatgcatttaatgaatctcctccaatagagaaaaattctttatcaacacttacgcgaatcctcaggatattttcatactcgtctaaaagtcccctttccaaaggagttgttatttctgttttttccttattattttcttcctcgtattgatactcttctgccaatttttttctatttatcttgccattatctgtaagtggaaactcatttatattaaaaatccgctttggtatctcatatttaggaattgtcgattctaattttttcttaattattttttcatcgtaataaagttttccttctactattccaattattacaattccattgttccttttaataggaattaccacagacctattttctgggaaaatatcggatacagcagcttcaatttcgcccaactctaccctgtacccattgattttcacctgattatccagtcttccaaggaattcaatattaccgtcattccagtaccgtcccatatccccggtacaatacagtcgttctccatttctatctaaaacaacaaatttttcctctgttttttctttatcgtttaaatatccctgtgcaacaccgtctccggcaatataaagcgtccctggtacccagtccggacaatcttccatattctgatccagaatataatacttctggtttgcaagtggttttccatacggaatactcttccaatcttccggcacaacctctggaatctcgaaatgattagaccagatactgccttctgttgctcctccaagagcaacaatctcaacattctggaacagattacgaattctccccggaagtgaaacaggaacccagtcgccactcatcattatcaaccgcagcgattgtgaagttacctgcctttgatattcctcatattctgccagcatttctacaaaagctggcacgctgttccatacggtaatattctcatgattcaaccagtgaatccaatgcgctggatcttttccatattccggatccggaagaaccaatttcccacctgcgcctaaaacgccaaaaacatcataaacagacaggtcaaaatgaagattggagattccaaacgccgtatcctgttctgtaatctgatagcgtgcattgatatccagtattgtattcactgcattatggtgagtaatcattactcctttcggcatcccggttgttcccgacgtatagattacatacgcaaggtctcccgccttattctcctgtgctttgtattcagaatcggtttttaatccagacacagaaatacaatcccactcgtgcagccattcggtatcctgatcatacgcctgattctgcacaagaatgattcttgttccactgtcacggagaatcttttcaactcgttctctcggattatggatatctatcggaagatatgcggctccggcaaacaggattccataaacagcaactacctgctcccaccctttttccataaatacagctaccgtctcttctttttttattcccatgctcttcaactgcccggaaatgtaaaacgcctcttcttttatctcccgataagtcatccgcctgctgcacgttaccagcgcctccttatccggaaatttgtctgccgcctccaagaataatccatccaacgttttctcttcaaattcagctgccgtttcattcgcctgacgccgtttttctgaaatttccgctgttaccagacttgccgttttttcctgcatgatctccggatgaactgctagcgtatgaagcaggccggtatatgcccggaacatctcatccagcattcccggataaaataattcgtccacggaatcccaaaacaggcataaacagccatccatttcaaccacctgatgatccagccacacctgcggcgtctgtgaaatgttatagttcagttttccaagccactttccttcattccactgctccacgccaaggccactggtaaacactaccggcataatagcgccccgcatatttccagtctttttctttaattcgcgctccagttcaaccgcgccataagctgtatgctccagatcttctgtaagctgcttctgaattgcctttgtcctttccgcaaaattattccctgcattctttatctccagcaatgtcagtgttgtaaaatctccaaccagattgttcacttccggatgcaattgtttccggtcaaactgcgtcagattaagtgtaaaatccttattactgctccacaagcggagagtctccgcataagcactcatcaaaagaacagaaggcgttacctccagtcttcccgccgcgtcttttacagactgccattctttctgtgacagttttgcgctccggcgacagaaacgctgctctgtaatctggctttcgttctttgcaagcggcagatccggtgcgtccgcaaaagtctccacccggtcttcccaatattttttatctttctcataagcagaggtagactttatctgctccagtcccagcacgtaatcccggaaagacaaagtaatcggcatttccgcttttccatttcgatatacttctgcccactcatttaagagatggaacatactccagccatcaaagataatattgtcaaaactgatatggattctatgcttctggtcctctattttagtgattcgcacatcaaacagaggccattcatctgtctgaattacctgatgagacatctctgcccgtttttcatccaatgccttttctttttctgtcacttccaattgtcggatatccgtcacgtcaatatgatactggggagtattctccagtatgcgctgcataccatccggctggataataacacgcatcatcccatgcctctgtatcaacagattccatgccgtctctgcgcactcagtatcaaggccgtctgcatccagttcaaaataacagtgcgttgcaacattccccaattcatacaatccgcttctgccaagccagtaagcatactgcacatcggttaatgggaacggatgatatgcttcctccagattcggtttgatctgcagtgtatcttcttctttctgttcggactgttcaatagcttttgccagagattttacggtcagattttcaaaaatcgtgctgatcgttattttgcagccgaaggttttctgtacttccgagatcaaccttgtggcaatcagcgagtctcccccaaggctaaaataattatcttcaattccgatattttcatatccaaataattgtttccagatatctaaaagcttttcttctgtttctgtcgttgcctttgaaaatcggataaccgcagtttcttctttaaaatcttcccgcaattgcttcctgttaatcttcccattggacaatgttgggagctgctccatgaaatgataattctgtggaagcatatactccggcagtttttctgacagatattcccttagtgctccattatgataggacaggacagacgcctgctgtctgctgcagcatatacatcttccatatctctctgtcacagcacagtcttcgcccaatcctgcctctgataaacattctctccacagcaggcaatccggggtaaccagccctgcttcttttctcttgtcccgaatatccgcaaaaccattttccaaaaaagccgctgtaagttcctgaaggtatgtccttaccacaaggtcagtcatcagcaatattccgtttggcttcagtaattccgctactttctttaccgcatccgcagcatcaatatttctatgtaaagcatttaccgatatcacaacgtcataactatgcaaggacatctgctgcttatccatgccttcttccagattcagcatctcaaactcgactctctcatatcccgcaagttctttctctgcttcctgcagaaaatattttgaagaatccgcataagtataagccacgcttacatcttccagtgcattcaaaaactgtcttgtaattgcagtgtcccttgtaccaatttctataatctggagtggctcttttctgcgttcttctgccagaagccttaatccctgcaccagtctttccactgtttcctcgcagcccggaatcctccgaagcagcatattcggagccaaagccggctctttctggtagaatacgtccagcggaacttcattcccagtaaccatatgcttcagatgcggcttcagtttattaaaatacgtttccgtatctccagctttttccggtacagccacttccttcccggtacgcgatagtctgccgtcctcttctctcaggattccttccttctttaaaatttccaaccatcttgccacagtattcttctgtgtttccgtaatgctccctttttcaaaaatttccttctgcgaaagaacttccttctctgatacaaaaatgcctaactctatgagtgtctccagcataagctgtacacatctctggtctgcataggcaaggaaatttttgtatgctgtcttccgttcctgctgcatctgccaattgctgacatcatccttcagttctttccagcccccgccaaagatatctgtgccgtacaaatacgttgtaactttagaatcttcctgtatcggcgctccgatataagcagccagcgttttattgccatgaccatcactaactgtatcaacaactgcatgagccacacccggaaactcctgaatcacatgttcaatttctcccaattcaatcctgtgtccgcgaatctttacctgatggtcttttcttcccaaaaattcaattgtctcatcatcccagattcttccgagatcgccggtccgataccatcttccatactgatctgtgataaatttctgccccgtaagcgcagaatctcccctatatccttttgctacaccaaaaccgccaatccagagttcgccttctgcccagtaagggcaatcccttccatactcatccacaacacgatatgcctgatatctgagtggctttccataaggaatagatttccagtttttcggcatcggcagggtaacattctgataattggaccagatacttgcctctgtagctcctcccatagcgacaaactggcaatcctctgtccatgccgcaaccctctgcgggagatccatcccaatccaatctccggaaagcataaccgccctgatcggcagtttctgtttcatggattccgcccgtatcaaaagcatatccagaagcaccggcactgaattccaaacggtaatctgatatttcaacacttgttccagccagtaatccgcattccttctctcctgctctggaagcaataccaatgttcctcctgcgcctaaaattccaaaaacatcatataccgacaggtcaaaatccatagctgatacagccagcgcccgatctgcacttgtcacatggtacttttcattaatatcctgaaccgtattccatgcgctttcatgcgcaatctctacacccttcggaacacctgtagagcctgacgtcatgatgatataggcgctgtccttcggcgacacctctggcagtctcacattttcctgtccctcttccataccttccatcacaaggatttccgtaccttccggccagtccagtttttcggataattcccgattcgtgaccacatagcggactcccgtcttctcatggattaacgctctccgatctttaggctggcttaagctgaccggaaggtatgaatttccggaaagcaaaattcctagtgccgcctcgatctgttctatcccgcgcggcagggtaagtgcaaccgggactcccttaatatccttttctgaaatccctgccgccactgctgtcgcccgtgcttttaattccccataggaaaccgatcttccgcttcccgcatcaataagcgcaatatcttccgggcaaacttccgcatggttcataacagcccaatgcaggcattccacacgctccggcactcctgtacgcgctgtatcttcaatttctctttttcttttttcaggaagcacatcaaatcgctgattccagtccttctttcccaattcatgcagaagattctcaaaacactccagcatatccgggatcatattctccgggaataacttatccacgctgtcccatgtaagctgtacgccattttcatcttcataactctggaagtcattccacacctgcggcgtttgggaaatcatataggaaaactgccccagttctttccggaacgtatcatttaccaacggcgttcccagattgcaggcaaaaacaaccggcgccactgccgatgcgtctccatacatctgtgcaagatctctctggacttgcacgccggaatatgccgtatacttcatatcctcatgaagctgcttctgaatcctgtccaacaattccgcaaaagtcggattttcttcgcagttaatctccagcaataacagagtagtaaaatctgctattacttcctctaacccctgctgctctgttttccggttaaaaaacggaatgttaataaggaaacaatgattcctgctccatcgttccagaaccaccgcatatacagtaagaagaaccattgccggagttgtctggtatttttttgcccgcatttgcaaatgatcccattcttccttttcgattctcacaatcctgcggttgaacaccgttttttccacttcttgcggacgttttgccaatggaaggtcagggccttttggcaaatgctctaaacgattcttccagtatttttctgcgtttttccgttcctcctcttcttcctgtttctgccgttccagataggaagcaaaattccacccttttgattctttcggcaggttttcccctcggtaagcagatgccaaatccctcaataatatctgcagactctgtacatcagcaaccagaagcgccatgtccacatgaaggcgtgccttattttcaggaaaaagcgtaagctctattcctgctacttcgccttcctcaatctttaacttccgatgggataaacgttctctgacagatactgccattgcctctgcttcctcagatgacatccgggaaaaatcatgaacctttattttttcacaatacggcttatccaggattttctgtgttccatcatccaaaaagcaggcgcgcagcataggatgatgatactgcagtacattccatgctttttccagacgctccggttctatgttttccccatcaaactccaaatatgcgtgacagtctatccctccaagatactgttcttcatccctgccaacccaatatgcatactgtacgtctgttaaaggaaacggctgtttcatatccttttccggcgttatcttagattcttgcgcccgttttttgcccgcttttttcttcatgctgctctggattaacgcccaccagccttcaaaggtgggattttccatcaatgaaccgaaagaaaccttaaccccctgttttctccactggtttaccagacgcatgatcgtcagggatgaaagcccaagctccaacagattttcggaatctccaaaatctctggctaccggcagtttttgtttgatctgttcctttatctctatatattccatgctactgtctccttctacttttcctgagccatccgttctaatgctttcttatctattttccctacgctggtcagcggccatgtttcaacccgttctacctgatctggcattttatacgccgcaacgcctatttcccgtagaaacctgtggatttcctgtaaatcgatcccggcttcatcatcggttacaaggaatgcgcatatccgatttccaagggtttcatccggaacgccgacaacggctgcctctttgatctccagatgcctgcaaaggtaagcttcaatctctgaaggcatgatcttttctccggcgcggttaatctgctctttgatcctcccacccaaacgcagtcttccgtctttcgtccacatagccttatcgcccgtccgataaaatccgtccggcgtaaagctctttttattcgcttcctccgccatataataaccatcaatcgtatacgggcctctggataataattccccaaaaactccttccggtacggtcttatcctcttcatccacaatcttcacttcatccgcaggagacaccggagttccctggcatcttacgatcagggaatcttcatcttccggactggtaaaggacagcagcccctccgccgtaccaaatacctgcatcagtttgcaaggccattcttcaatgatcttatctgcaagggaatcttccagcattgcgccgcccacctgcaaaattcgcaggctggatatgtcataatcttcatcccattccaacatttccatgcacacagtaaccatagcaggaaccaatgcggtaatcgtaacgccttcctctgtaattgcgtcaagaatatcgtccgggctggtcgcagacgcaagcacaacttttcctcccacatccagcgtacctaaaagccccgggcagcataacggaaaattatgggctaccggaagagacgtcagataaacgtcgctgctatccaggcggcatcttttcgcggacatacgggcattatacatataatccgtatgggtgcgcggaatcagtttcggaacccctgtcgtcccgccggacagcaaaagaaccgccgtttcatacccatccacagccggaaatgctctattttctccacacgtttccgcaatcattccactgatatccccggattcgctatctacaaatatatgccggatatatgaatatttctttttcatcgcatttgccatcggcacatatgaaaatcccaaatatttctccgccacaatataagcggccggctttgccagttcaataattccttccagttccgcctccctgtgggccggcagcatcaagatcggcaccgccccgatcttggaaagcgcaaaaaacacgaccacaaaagaaatcctgttcggaagctgtacaagcactttgtctccctttaaaatccctttacgcagaaaagctgccgcaagacaatctgctttttgctttaattccatataactgatctcgtcttcgctgtccgtgaccgcagttctttctccatatttttccgcccacttatcaagctgttctccaaaactacatctctcccaaccttccagatactcatatttgctcatatctttcttataacccatttgattcatctcctttcttatgcaccgccacatacgcagcatatcctttgatcctgaccggatacaggaaccagccctgatcattcctgcctttttctataatttccccgtttctgacagagaagaaatccattcctcttcctaatccaataccgagcgcttttacatacgcttctttggccgcccagtactggaaaaacaaagtcgatccttcctttattacatcttccgcttcttcttccgtataaaaattcccggctatctcccagtaatccggacatcccgccatttcctgcacatccactccgatgtccattccaacagcgaatcccgccagtatgaattctcccgaatgcgaaatattaaaatctacggtctgctttcctgcaatctttttatgataaggcttgccccgttcactgacagaaaaatcaatcgtttccacatctaaatatcttttcaagagaagccgcacgacaaccttcccggctatataacgcatcctgtcttccgaaaagcggaatcttccgacctgctccgattcctgctcactcaggatatattcatggttcacccagaaatctgtcatttccggccagcagatgcaccatatatgtatctcattttcacggatacaaagtttgcctgccgccagaaattccttcgctccataccgtttaatctccatcttttattcccggcaggcgccttataacttcacttattacttcgtcttcgtaatcccgcaaataaaaatgtcctcccggaaatatccggtagctaaaatcattatccgtatactttccccattcgcagattgcgctctcatccgcttcgccatccttttctccgccaaatgcagcgataggcgcatgcagtactattcccgtcttgtcataatatgtttcatccatggtaaaatctgcccgtagcataggcagaaagaaatccaataattcctgattctccagtatctcttttggcgtcccctcaaatcttcccagttccctcttaaactcttcatccggaagatgatagatcggcttcggctccggaatactgggaatccggctaccggaaataaacagacagctcgctgtatatccgaccgcttccaatctcttttccagctcataggcaatcttaccgcccatactgtgcccccataaggcatacggtccatccacaacctctcttactgcctcttccagatcatctaacataaccggcatatctatatacggcttctccatgatccgttcttcccttcccggaagctgaaccagacataccgttacttttccctgcatctttttcgcccactggttataagcagaagcgccgccccccgcaaacggcagacaaaacaaagttattttctctttgttaatattttctgtattttttatcaacttcaaattcacttttatgttcctcttgcatcatgttcttttttattctgtttattatcattttgtgatatgcttttcccaagcatttcttattcctatccaggattagttaactctaactctttgtcaaaaaaaatttttgatccatcccaatattaaaccggacgccaaaacaatatgcgctaccataatcccgtttacgaccaggaaatatccggttacagaaaaaacacctgctatcgcgcattcaataattaaaattgccctcgcgcgcataccataaactttcttttctttctcatccagtttcttactgctggcatccaccggtgccataacaaatatgactccaactgcagcaagccatatgatccgtatttgccacatcacagccgaaccagacgccagatactgaccgcacagaaggacaaggatactggaaacaaccatgcagctccctgctttttctaaatgaatccctccggcatactgccttagaacagtaaagggcaataaaaagactagcatctccagccaattccccgttacaatgccaagtatgacaatgataaggtatatcgccaccctgcccagcagtacgccgtaagcatattcatacagcctgcggtctttctcttcaagaatcccgttcctgttttgcacttcaaaaagccagccggtagtttttttccacactagaatttcctcattttcttaacttcttccggctcttcttcctgatagtacagccagttgcacgccagatttgccgtatatgccgtcaggcagagtgcaagacagtttacaactccaagtactttgatacccaagctttttctgattgtttttttcatagttacatgcctccatttttttccgatagtttacacaaaaatcgcccttttttcaattaccgtggcaaaaacggtaactttttgggcgatttttgcacatctttattttattgtaaagatcagcttaacagagaactcctgttctccgacctccactctcataattccagcatactttttaaccagttttccaaccgtatgcagtccgatcccgtgactgtctgcatctcttttggtgcttatgtaccggtccttgtcctttaacagtggaacaacatacccgttgcaaaattccataacaaggaaatgttcctcatttcccatatacatcctgcattccacatatcggccatcttttgtcttttctgccgcttccagtgcgttatccaaaagattacctacgattgagatcatatccagttcttccagaaagtccagcctgagatcattacccagggtaatcttataggaaatattcttagattccgcaaggaatttcctttcgcacaggatgctgttcaagatcgggtgttcgcaatacacacctttttgaaggctctgaatccggacacctaaatgttccataatctccttaacctcttgattttctccttcttccatcaaaccggctactgtacaaataaatttatttatatcgtgtaagaatgccctgttatcctcattgaccttattcatatactgtaaattagcaatctccgccctgcttttctggtatagccggtccatcttcttcacttcttctgatttttctacaaacctgtcaaatactgtgaaaatgaagatattcgtcattaacagaagcgaagctcctaccggaaccataaccctgttcattccttcaaaagaaatatttgaataaaacacacatcctaatataatgatcgtagcggttggcagcatgagcagcacagtaaaagttttattctcaatcgtcagataatcccttttccttgttacctgattaatgcatttaataaacagaaatgtcatggtactcatcagcaggagtgctaatgtcttttctgtttcagtcctgaagccctcggacgcaccagtcacgccatatgcattcgtaagtgccgcaaagagaaattcgggaataattgccagcacataatagcagcataccgtaaccagcttcttccatatatttccccggaacacaaccatagacgcaatcatatagattaccggaatcattaccatattaagtattgaggattccaggcggttggttccgaacattgccagtgtgttattcggtgaattattttaattaactagttaatataaagtgctaaataacagccagtgctgcgatacaatatacgagaaatttttcccagaatctttctcttctgtatgggagtatgttcttttccaagtcctccaacagatacatctgaagaagacaaatcaaataatctcttattatcataccatgccgttcctttccccaagaaatgttatcagtgcgtcggcaaactgtccttttctcgacctcgaaacattcaactggattccaaacggcagcaacgcaacgttcttttccaatccttccacttttgccaaattcacaatatagctgttgtgtgcatactcaaatccccttccggccagacactcatacagatcacttaaagattccttgcaatgcatctcttctatctttccctgtctggcaatgtatatcgtacagccccttttcgccagacagatatataaaatgtcttccgtatggatgcgcattatccttcccgccgatgtaactgtcacggaagaatctccacagcacaatttcacttttaataaaatcataggtatttcctttttcagacttctgtcatgcagatccttcatgatgtaccggaacggttgtccaacattaatgctgtcaggagtcggttcaaaacagccggagcagaacaccaatatcgctgcttcattatattccctcagcttcagtactgttttatttccatccaatccaggcatacgcatatccataaaaatcagatcatgcaaaatatccgcatcttccaataattcttttcctgattcatattcataaaaccgtatctcattcgaagacagaatcccttccgtttctatgaccgtctttattttctccctgtattctttatcatcgtcgcaaattgctattttacacatattcatcctccagtgttagtttcttctaaccctttcccataaaaaaaccatcttgcagaatctgaatcctaagattatttgcctgttcctataactccggttccaaatctgcaaagatgggatcttcaaaaaattcctgtattgtaatatccaatccatcgcatatctttttaattgtaactacgccagcattcctgctttgtccatacaaaatatttttcagtgttgaaggcgggacgcctgagcgcaccgccgcttcattcactgtgatatctttctgcttaatcagatcgtttaaccgatatatgaccgctgtttttatatccacggtatcgaccacctttttttcttctattttatataaatcggctttaaaaggtcgcccatatatagtctttttgatctatgcacgatatttttttaacagtttttcttattctagcagaaatccgctaaatttctatattttattagatacatgaaaccctgtgagaacatttctgatcctacgcagggttttccactttgttataaaatttttatattttgcagtatgctggatcggagttatcattcaactttccttctgctgccgattgtaaaaacatatttttacgaataaatattcagcagttcttccggagaaagcagtgtaatccaaaaggaaagaaaatcctttttattccttgtcacaatcgcatcacactgattctccttcgtacaagttgcaagtaggcagtcttcaaaatcagatactctctgcaaataagcaggcagcacatcttcgttcgtcactgtcagcacttttgctatgtccaaaacggagccaagtgcctttctataaatttataccgttcttacatcccgatcagctcctctctccagctcatcttttccctgcttttcttggatttttctcttattgatttccagtcgttcatgaatagatggcttctttgccttcgtagttgctttattcttttctgtttgcatactcgaaactacctttttcacagctttgtcattatccccttttgtcacattcgctgctcttgacgcttctactctgctgtcctgcttttctgcaacctgccgttcctgcttttcctgcacacttttttcttccagactgcaaaagctctgcaaatatggcagcacatggttctgcatatcggtcagatcttccatacacttctgaaactcttcatttcccttgtttttcagataaccaatccagctttcatccgtaagtttcagttcattttggagtttcagctgacttaaaataccgccatttcctgttccaatatctattttccctttgaaatgttgcatcattttatcgcctttttccgcataatatatagtaaaaaacatctgggctgttaccatcggctcatccgtcctcggattacggtctgcgtaccattccttatccttctgtgcagtacgggaatccaaatctgagagcttctgacagcgtggttccatcagctctcgcttttcacagtaattcacatacaccatcggctctgtttctttggatatatctggttcgtaggatttcagccgttccagcaaaacacctgcccacacggactgctcacagtcttcttcaatcacatccttcagaaaggaaatataagaaccaacatttccactttgcagatccagcatgacttcctgtatggtatcctgccctggctctacatggtcccgatagtcatacggatcgaagtcttccgcaatctcatccaatgctgctgccagttcttctgttgtcatttttttcggatacattgcctcacgcacatcctgaatcgggatatatttataatcaggcaatgctttatgaatcttctccaaaccttcacgcaccaccggctgatcttttaaaaaccgcacattatccaagaagtcgccgtgtatcgttgttcccattacaattaacagttctgtttcatcaaacaagctatcctccggatcacgataaataatccccattccactgcctttataagcgttttccggatcttctctgtacttctcatagattgctgcgatttctttcacatctgtgcttttctcataagctcccatatcatgaatttcatcacattctgcagcataatattccagataagcttctttcttaggcggcatattattgagtacattatcaatcatgttataattggcctcttccagttcctccacctttgccaatggcttatattcgccctggcttttctgaatctctgccattacaacttcatccatttcttctactttctccatcaaccgatcataatctccacggatgcgttctccagtccagccttcgtcttccaaaagttcctccgccgcttcttgaatagaaatttcatcattctcataaacgccaccatccatcaagcggaaatcttcatcgtaaaaggaataatcatatccttcttctgttctctgaatagcaaagtaacgttctcctacctcatatgccagttcactaaggacctgttcttccagattcaggaaagaatctagctgttcaaaactgatactgtctacaaaatgagcagttactttttccccgtcattcagaactacgatatcactgacagacagggaatgcccacggaaatcttccggtctatcaatgttgaacctttcaaaaatatcatccagtgacatatttcctgataattcaccaacatagaccagcttgtaatcttctttttttatcttcataccatgactttcaataaaactcatattcataaaagcatagttttcgcccggtgaatcatcccggatctgataaataccaaatacccttcttgttcctaacaacaggtttgcttctttcaatgactgaatctgtggatatttctgcatttcccattccaggttacggaaacgctccagttctgtcatagacatctgataatgctctggtcctcgttcaatttccatacgttctgtgacatacatcggtgatgaaaaattagtgatcagatagatatctgctcctgcatcgtataatttcagtgcttcttcctgctcaatgacactcataggctcctgaaatgctcctaaattttcttctgcatgatctaggttgttatcctttatccgttcccacatctgcaattccattccaaacaaaccgtcgtgtgcctgtatcatttctttactcgcatattcacctttactgccatcacttccaaggcaataaatcttagaacccattctgtgataatccaaggctgcttcttttctaagtggcaccatatcttctgctgtatatccatagtcacgtaattccagcttacctatggttggatccagcagttcttgaatatccattcttgcgtcatccagcaaatcctctacaccttcttgatctgcctgactcactgcatctgccagatttcttaccaaattcctaactttctcttcctcgccgatcagattcgcatattcaaaaatctgttcttttacatctgttgaaaattctatatctctacgctctgcctgagcaatccgttcctgcgtatattcctgcattttctgcgtttcttttcctgttatcatacttctcgccattcaaattcctcctgtgttctaaaaaatggcataacaggcagaaccttcttctaccaaattatgccatctttcctgtttatttattccagaccgaagtcccgttttctgttttccttgccagtttcactttcccgctgactcttttctttataaatctgcagtttttcatggatagaaccacgtgtcggtctttcttctttctcatctgattcagacacctctgtttctgcatcttcccgttcatccatattgagcaatgcatttaattctgacagtcgctccagtttctggttcaactcctcttcttttggaaatggctttccaacctcttcttttgcatttgcaagctgttcatatactgtttccagtctttgttgtgcttctgaaagcttctctggataactgtccaacagattgttgatacgagtaatatttccaagtgcatctgctccaagatgaactttcgagacagcctcatgtttgacagatagaataaattctttactccatccatcaaactgaatcctcatattgaatccctgatagtttccgatatccatcgcagcatctacagctttaatatctttacataccgccagaagtgctgctcctgcctctttcttttctgtgaactctttgccgccaatctccatagtaaactgctctggatctgtgattttatgctctgagtaatgagcgatgtctgccttgtagctgtcaatgatttctgtcagttttgcaatctgttgtggaaaattccttgcaatatcatcttccaggcggtactggttattcatgtggttggcttttaaaagttttaattttgccacatcaacatccaatgccatcttctcttttactgctggatttccggttgcaagagctttgacctctgcataggaaagtgccgcttcgtccacatcttcacagcttcgcacaggtgctttgctggtcataatctgagaaatgaatttctgcttgttctcaaccaactgccacatgtagctgtcaaatgtggattcagttacataccggaagatatgaacctttttattatgatttccctgacggataatacgcccttccctctgttccaaatcagatggtttccagccaatatccagatggtgcaacgcaatcagacggtcctgcacgttggtcccggcacccatctttgctgttgagccaatcaaaaaacgaacctgcccggatttcacttttccaaacagctccgtcttctttgcttctgtatttgcatcatgaataaaagcaatctctttttccggtacacctttcgctatcagtttctgcttcaagtcatcataaacattgaaactgccatcacctttcggtgtgctcaagtcacagaaaatcaattgtgcagatttctgtgctgccgtgtctttccagatctcataacttttctctgcacagactgatattttgctttctggattatctggcaataattcgttcaccaaacgctgatccaatgccaattttcttccatcattggtaattttcagcatattatcaaccgaagcatctacccctccgtttctgacaacttctgcacgttcccccagactttctacgatttctttctgctgttccgttggtttcagcaccactgtttcatattccgcctctggcacaggaagctttaactgatcggaagtcttgatatctgcaatctccttaaacatattcatcagttccggaatattataaaatcttgcaaatcttgactttgcacggtagcctgttccttctggtgcaagctcaatgctcgtgactacctcgccaaaggtggaggcccaggaatcaaacagtccaagtcccatattttgtaatttgctgttctgcagatacctctgcataacatataattccgtcatgctgttgctaatcggtgtgcccgtagcaaaggtaatgccttttcctccggtaatctcatccagatactgacatttattaaacatatccgccgacttctgtgcttcattctgtgcaatcccggctacatttctcatttttgtataaagaaatgcgtttttataactgtgtgcttcatctacatataaatgatccactcccagttcttcaaacgtaactacctgatcttttttctctttctgattcagtttctccagccttgtctgcaatgtttttcttgtcttttcaatctgtttgacggtataacgtccaccatcctgttcataccttgcactctggattgccatttccagatcatcaatctgcctctgaagcatggcttcctgtttctcatcagagattggaatacgctcaaactgggaatgaccaataataacagcatcgtaatttcccatagcgattctggcacagaacttctttcggtttgccggttcaaagtctttcttggttgctaccaaaatatttgctcctggatataactgcaggaactccgctccccactgctctgtcaaatggtttggcacaacaaagagattcttttgtgataatcccagacgtttgctctccattgccgccgctaccatttcgtaagtcttcccagctcctactacatgtgccagaagcacattatcaccgtataactgatgtgcgactgcatttttctgatgcggacgaagctctatttccggattcattcctggaaaactcaagtgactaccatcatattcacggggacggatactattgaaacgctcattgtacacgcttaccagcctttctctcctctgctgatccttaaaaatccaatcttggaatgcagccttcaaggcatcctgcttttgtgatgccaacatagtttcttttttattcaaaactcgcacttcatccccattgtcatttacgactttatcatagattctaacatcttttagattcaaggtatcttccagaatccggtaggcatttgctctctccgttccatacgttgcataagcaaacgcatttcttggactgtcggcgttctttcctgtaatcctccactcaccatttacctcagagaattttacctgtatttccttctgtgcaagatacctcggcgtatgaagcagttccaccataaaatcctgataatccgaaggttcaatccaggtggctccaatacgcacttcaatctccgacgcttccagatctcttggctgaactgcctccaatgcacgcacattcggtgtgaattccggatgattctctgcaaaagttctcgctgtatttaatttatctctgacgtttccagacagatattcatctccgctttcccactggtctgtcagtggatttttgaagataactccaaccagctcttctgtgattttctcttcggtctttccggtcaactgtgccatatatggaagatctactttagccttttcatttagggacagagcaagtgcttctgtggctgtctccacacttgtcacagcgaccgcctttttaatggttcgtttggtgaacatgtccgctttccgcttcaatgttccatcttcattcaagtcttccagggaacacagcagacaataagaagagtcatcagaaaatgcacgtttgttagcattacttccaataactccatactttgctgtgtaggtatcatacacctgattcagttttttctgctgtttctggatttcttcgtctgtgacaaattcttccatctgcatggcgatcagttcacgaacggtatcacggattgcaaccatgccttttacacgttctgcagtgactgcaggcattttcacctgattcatcaaagaattgacacggtaatatacctgatcatctaccaccgtatagctgtaatttcggacattcggatctgccggaatactctctggcatctcatccagttctgcctctatatctactgccgctaccatgcttcctctgatgtgttttacaacttcttgtaactgtaattccagatcagctccttccattggagcacaggttgtttccataccatacggaccggacacttctttcatctcaccaagaatcaatcccggatgctgaacaaaatacttgttaatggtaatcccatttgcatcactctccaaattcacccagtctggcatcacttttgtgaaactctcacgcttctggaaaaacaaaatatcagcactgacttctgttcctgcatttgccttaaaagctgtgttcggcagtcggatagcccccagcaggtctgcacgctctgccaaatatttccggacttccggtgattccttgtccatagttccctttgttgtgatcaacgcagctacaccacctggacgtaactgatctatagtcttggcaagaaagtaatcatgaatcataaaattgtagcggtcatactgacggtcattgaccttatatgcaccgaatggcacatttccgattgccacgtcaaagaaatcattgggataatccgtcttctcaaagcctttgatctggatattggcatctggatagagaagtttagcaattctgccactgatgctgtccagttccactccatagagtttggactggtttagattctctggaagctttccaaagaagttcccgactcccatagatggctccaggatatttccctttgtaaatcccagattctccaacacctgatacatactttcaatcacaatcggctgtgtataatgagcatttaatgtggaagctctggctgcagcatattcttccggtgtaaggacggtctttaattccaaatattctgtctcccatgcagattttgtctcatcaaatgcatctgcaagacctccccagccgacgtacctggataagatttcctgttcctctggtgtcgcattgcggttctcatcctcacatttttttaacagctgaatagccataatattggctcggaatttctccttcggtgttccctgtccaagttcatcatctgtgatatggaagttcgttgctggaatcagttctgctattccgttaatctcttccaatgattctttttcttccaatacctcaacttctcccgacagttctttttcttttttatcataatctgtccacacacgtttagaaatagcagtaaaataggaagactcttcctccatgatttcttccttgatttcccgtaatttatctaaggtatccgcatttactgttttgttgtgataatgataataaagtacttcttgtccaagttttacatccagacgttccaattcttgtgttgacattcgctcccaaatatcatctttttccgtatgaatcgtgaaaccttctccatcatcatgatattctaatgtgtattgaagtcgattctcttctcccttaactttgcaagcaaaatcatagatttttgttctggtaccggacatatattctgaatcaactagtcgcagatccgttatatcttccgctgtaaaagtatcctgttccagctgttctcctaacatctgctgtgcttcttccaggtctgccagtctttgtgcttcctgtcgttcttcgtacttttccatttcttccggtgacaaataatcatctgtgcggattaactggcgaacacgttctgcaaccttgttccactttaataaaacttctacctctggactgccaattttcccttttgcaagttttaatccttttgcatcatgggatgcatcggaagcatctgctcctggtattccgggtgaggaaccacctgttccatactcatttttcaggaactcagctgcatctttcatatcatgatgttccatgaaatactcatagattcggttacgtcctcctgcagtaatgccgcctcttcttaacactgcgtcaatttcatcctgtgtgataaaggatagtgccggacgttcgaccgtaaatttctggtctacccaggaacgctccctctgaagatcctgaaagcgttggaaatattccggattatgctgaatctcccagcggtgataatctcccggattctcatccatatatttctgcagccattcaaaacgatagacaatcgcatctgcttcctcttgatctgtccatgctccactcactacatcctgccagtctgaatatgattgtttcttttcccagtttctgcaagtatcccgaaaatgaagtgcaagaagattggtcatttcttcctgctcctgttcaatggcattattggaaatcaaattatccacgtaatttccatcctcatacatatcccgaattctgttcgctgcttcttcccacgtaaccatgcggtcaaagtttcttctggcagagtcccctcgccggatacggataccatcattgtcataccagatactgattttctgaccatctatggtaaatcctttgccaccagttccatattcatctttcagaaaactccgcatttcttcattatccagaccttcaatcagtcttgctgtaatatgaaacagtgtatttttctgtccgcttcccgtgcggagaatatcatttaccacttcatcggaaataagaaaagcggctggctgttccaatgcagctgccgctttccttatttctcctaactgttcctcttctgttgggaacagacttaactgtaaataatctcctgaatcaccagctcctctgcctgtgccttgatctggttcatgtgtctggtccatgccatcccgtctgccattttgtccggtgccggatctttctccagaagttcgttcatcaggtcgtctactctctgtcttgcctggctgtcgatctccatcagatgactgtccagacggttctgcagtgtcagaatgttgaacctggctaccttgtgatttctcagatactctttccgcatcattccgtacttgccgatggttcctctcgtctcttccaggctgatatctggaatctgatactctccgttctggctgtaactgatctctctcatagtctgtttcctcctttttttcttctctatcttctgtgttatctgtattactttcacgcattaacgtgttaaattcattatagactacttctttttcttttgcaaccgttttcaggtcattttccagattattcagcacatatcgtccaatctgcatcaggactggtctgctgatctcattgactgcacttcccagatgtcctaatactatcagctgattaaagtccgtaatatgccgaaaatcctctgcatccagatattcctgtgcatccagtccacaccggtttagtaatacataccagacactattggtcatcagttcccgaaattcgacttcctgattctgttcgtccagttcttccagaaatgtccctgttacgtccagtctcagttcttccaatgcatctggaagccattcttgcatactctccttcgctgcctgatgcagactttcagcaagtcctccttctgtatcttccagtgataactgctcctgcagataatctgccaccagctgttctccttccaccggaagattccataactgaggatcctttccaagattccgcactttataagtgtcctgcacatcaaatacataccgaagtttcgttttcggtccggaagtattgtcaatcaaggcaatccctttggatccctttttgatccagcggtacatcttctgattccagatttccatggatgctacggcagttgcttccggtcgctgtgcataaattaaaagctgttctggaaaagtgtatttgtacagtctggatgcagtgtttaggaaccgcatccattcctgcggactggcagctacatcttttgccacctcttccgtcagctgttccattgcatataatttatttgccatgcgctactccttttcataaaatcagggactgcttagcacagtccccttaaaatcatcgttgttactctttataatgctgtggcaagctcttttgacttattctttggcactttgtctccctcttttgccttgatttctgccttagctttctccagtcttccatggattccaccttttacttccgctttttcggctgctttttctttctccaaacgagcttccctacgctcagcattttccataactgccgttttcccatcacaaaactgaactttatcggaaagctgctcctgtctctccacctttgtctcattgacttcctgtaccatcgcatttaattccggaacctgaaaaatgccgttatcaggaagaatcagcacttcatgaatggaagatgggatgacaaagtaatcacttcccaggcattccccaatctgtttacgaatatcttcctgcagtaacagggaagctccattcatcttagctttgtttgtcagacagaacattgggttttccatggcttccatatccattttttcattcagcaggttttctggttcttcaccaaaaatcatagatttgataatctcattcatatccataagtgtgacaccacgttttcggtctgccaccatcgcatccgcttgaatctgttcggcagatactccccactcgttcatcagagaaacagttaccggaatactgctgatcccttctccattttcctccagatttactgcataataagctgcaaaatctccgtgttctgtgactactttatctgcaagaagatcggtattccattccttatcacaaattctcatctgtaatttgtccttcatcttttcataatccagaatatctggaactcccatatcaaaaaattctgcttttccctgtgcctcaatacgcatatcagccacatcgccaacacaagagtctacatcttttccatggatatattcctggtagagggaatccagatagactgtcggtacgattctctgatctccattcggaatcgtaatacctgtcagcttcaaaccattgtttttttctacttcctgcagtttaatttctgcatccttataagactctggcagatactcctttacattgtctttgacatattcataaaattcttttctgttcatcatacgcttttacccctttctgatcatgtgatggttcattctttttctgctgaccatctgctcggatttcttctgataagccatcattctctttaaagttttctcctggttttttcgtgcttcccgtcttttttccattgctttcatcatagttttctgttcctttctgtgatatttttgtatgaaaaagggagcctcacatagaagctcccaatcataaccgttggttttagtttccttatttgcttttccttttcctgctgatatacagtcctgccatacctcctgtggagattacaagaagcaggatcggcagccagatattcgtgctgtcacctgttttcggtgcgtttgatacctttgtctcttcatgggattgtggtgtgttcggtgtttctggaacttccggtttctcatttgtcagattaaaggtaacttctacaaccggtgtactgtcatctgcataggcaaatgtcacttcatgcttggtctgatccagtgtgtatccgtccagtgtctttgtttccaccagataatacttgatagcggtatcatatttgccgttcttaaatgtggcaatctcatacagcttactttctgcatgaccggcagcatctgtctttaaggtttccagaacttttcctttgctgtcacgaagttcaaattctacccctttcagcggttctcctgatgatttatctgtcttattgagaatcacttttcccttggcagtgtcatctttcatagctactttctggatctctccagtatcctttacttcaaaactaacatccgatgtcagaagatatcctttcggtgcctgctcttcacgtaaggtatatttaccgattggaagtttttcgatatagtgtgcttcctctgtggaagtccagctctctactacctgatcatccttatcgagaatcgtcagtttcgcacctggaatctcagtttctcctgtgatatccgtcttactgatctgcacttttgtcacatcatctttcatctctactttctgaatctcggctgtattttctactgtaaaggtaatactttctgcagtgacatatccatctgccggttttgtctctgtcatggtgtattccttaccaacaaccagttctttgatcacatggggttcttccgtagaagtccattcatccactgcattgccatctgaatccgtcactttcaggtgtgcacctggaagttctttacctgttgtcaggtctgttttggtcagctccactgtggttggctgattctcaaaagtaaagtcgtagcttacttctgcctggtcttctccggcatattcaaaggtaaattcctgtatttcttctgttgtaacaaatccgtccggcgcaaagatctctttcacatagtattttccatctaccggaagatctgccgtaaaagtaatctgtcctttttcatccgttaccctctgctcgatcagactgcctttctcaaggagtacctcgccctttgcatttttgatatcttcactggtataaagaccaaagacaccacctgcaagaacacgttctgtatctttttctttcttcagaaccgtaacctttactttctgacgggcattctgccatttctcatcataagtgatgactggtgtgtcctgatcacggtaggaaaggtcaacatatctcggctctttgtccagcacataaccgtgggctgtttttacttccttcacatagtattttccagccgggagatctcccatctgtgcaataccattggaatctgtggtaatggttcctactttttcatctgctttgaaataatcttcactgacaccatctgccgctttgatatcttccgcagcaaatacatcgaaagtcacatctgaaaggcttccggttacatactcaaaaagatgctccacggtaccttttacatgatccaaaagtgtcaccttatccagaaactctccatttttgttgatgatcagaagtcctgttggaacttcatctttcatctctactttctgaatctcggcagtatcttccagtgtgaacttcacatccgtcgttttcagatatccatacggtgccatttcctctcgaagggtgtattcttcacccacagtcagtcgtttgatcacatgtggctgatcttttacagaagtccactgatccacaacatttccttctttatcaagaacggtgagttttgccccatccagttccacacctgttgttacatcagattttgtgatttcaactgttgtcggctggttctttttcactgttttcagttttactgtcttcacatcctgcccctggtaagaagcatccagattcagaacttcatcagaggatacaaatcccgccggtgcttttaactccttcacataatactgtccaagtggcagatccagcgtacatgctgcaagaccatcgttatcagaagtcatttcctgtaagagtgtgtctgctttcacgattacttttccatccgccttaatatccgccttgttatagataccaaagacagctcccgctacggttgcaccattttctgcatcctgtttttctacctggattgcaactttctggcggtcatcgccaaccgtcacttcctgttcgatcacaggtgtatcctgatccgcatagacaaatgagacatccgatctgtcatggttcaggacaaatccttccggtgcagtcttttctaccacatagtaagaaccaagcggcaggttatcagcaactgcttttccgtcttccccggtcgttaccgttgttaccagtgcatcttttgcatagatcagctgtctgtttctgttttcatctttctgataatccggtgtatagatattttcagctgcatagacatgaaatgatgcacccttcaggtatctttcttcataaacaaaatcctttttaaatccggtcagcatctcaccttttttatagatcgtcagttttccttttaccggatggttctcgtagtctaccgtaataatggcatctccgctctcagaatccatctggtatgctgtgtttgcatccaccgcaatctctacatagttcttattgattgtgtacccttccggtgcgttgacttcctcaatccggtaatgtccgatcttcagattcttcggcatgatcagatatccctggctgtccgtaaaataggacttgtgagtagttgtcactgggtaagttgttacctgctccacatacttcttgttgtccaggtcatataccttaaattctgttccggcaatcaatacagatttctttgtttcatcgtcttttttcacgattttcagttttgccttaaactcttcatccagaagcactctccagatctgtggctcgtttggatgatgttctgtgatattcacttcaaaatcatcgactggcttgtaattgtgcggtgttgtagtttcacgcacgatatagcttccaaatggtaatggaatactgcaggcataccctttttcatctgtgaaaatctcagttgctccattttctccactcactactggtttggcagaatcaaaatcatagcttccatctgctttctttgtaagagaagatttcagataaactgtaaatccggctccggataacagatctgcatcggtctttccattgttggctgccttgatgatctgaaatggctgtttgatgacctgctcactggaagtgcactctctttttacttctgctgtcatatctccttcataactgcacacaagatcatgctcttctgtatctgccaggtatccggtcggcggtgtgatctctttgacataatattttccaagatataaaccttttacagaagactgtcctttgtcatctgttgtaagagatgctacctgttctcctgctttataaatagttccggttgctccgtccggatgcacgatatcttcacgggcatacagaccataaactgcacctttcagtgtggcatctccctgtggtactgcttttcctgtttctttatcaactttgaataaattgatctttgctgtcacacggtcattgctgaaggtatgggcaaatgatacggttgcttctttatcattggtgtaagaaaacttgaacgtatacacatcttctgtatttcttacatagccttccggcgcctgatcttcttttacggaataggaatatccaatcggaagatctgctgtgaattttgctgttccatctgctccagtagttgctttctcaatcagtgttccttttttcacaacaacggttccgtctgcatttctaatatcatcggatgcatacagagcaaaaataccgccattcagtggtttctttgtatctttatcctgttttactacggaaacatctgctttctgtctttcgttgttaaaagtcacatctgcaaatacaacttctttattctgtccggcataagtcagagtcactggcttttcttcgctgccgttatagaaattgtccggtgcttttgcttctttcaccacatagcttccaagatgcagattcttcagtgtaacagaaccattctctcccgtagtcagattatcttttaccaggtcacctttgctgtacacttttgtgccataagcagttacgatatctgccccggcatacacgttatacactgcatttttctgtctgcggttttcatactggaataccgttccattttcactgacatctgctccggtaagaacttgtccttctttgtaaatggtaagctctgcaagctgttctttattttctacagtcacagaggaagtcttacttgctaccagttttacatttgttgccgttgcatttactacatatccctgtggtgctgtgatctctttcagataaacggtatcctgtgtcttgatgatcgtaacagaagattttccattcttatctgttgccggcatctgagtgatcagctttgtacaagcctcatcgctgtatacaccgaatactgcacctgcaagattgacatccgctgtatcgtctttctttacgatttcgatcgtagcctgttcaatccaggacacctttaagcttacatatttttcatcagcgacaccttctccaaacacaaatgccagatcctgaacacttgcattcgtagtcagtttatatgctgaataatcttttgtaatactacccttcatttttgcagaaaaagtagcacttacatcttttgtctgtgtcagaggtgctgaaagataaaacgtagttcctcctccaattgttacgcttgcacctgccgcacttacatttccagtagatacattatagagctttacaccctttggtaagtccattgtaattttctgctgggaagatgcattgaacttaatgttctccgttctctgaacatttccatctacataagcttttacattcggttttgaaaatgacatcgctacatctggtatttccggcttattcacacaataattatagagttcttttgccaaagcctcgcctgtagcatttgttccatagaatgcatcactgcttccattggcatacgatgcagccatgtgaataatgataaatctttttccttctgagaaatccgtgtgtttattcgcaaaaaaactttcgctccctgcggcatctgtaccgtaataacacacttttgctaacgcctgattgtccccgatctttgtgattgtataatttccagatcctggtcctggttttgctggctgtacacaatacgcagttgctctgacgcttccgtagctgatatagtacggctctgtcagataggttccaagattataatctgcatatctatacagaggtcctttttcaatcgttacctgctgtgtagttcttgctgaataagccgaaactgcttcaaatgttgcaatctctccctcttccatagaatcaagatccaccccttcgtctcctgcctgttccaaaacatcgtgaagctctaaccctgattcttcatcataggtatcctgattctgtgcctgctctactaaatcatcaaattcatcagcatcaatatcggtaatctccgagtctgcttcggaatcctccgcttcttctgtctgctgttcactgccagctgtttcggattcggttaccgcttcactccctgcagtttctgtctgcacttctgtttctttctcacgcacaatcagctttcggctgatctgatacttcggatgctcctgatttaccggttccacataatagaccgctttgtaagtgtccgcatgatctgtcgtaaaatcctcatccttgtcgttctttgcttcctcgaatgtgactttgaccttgttatcatccttgatttccagtcctgtgtagtctgatttcacatcaaatacactgcctgtttcgatttcataatctttggcagtcaccacctcatcttcatccagaaggtctttcacttcctcataaagtggcggtttttcctctggctggatctccgctgcatatgcagtcatcggagataacactgtactaagcattgtcatgcctgccagcaatccagatactacttttctaaaattaccttttttcttcatgctaaggtcctctctttcataataattgtattaaaacagacagtccttagactgcctgcaatacactacttatcgttgtggaaaaatcagattgaactgcacattcccctcgccgggatcaaccatttccacagttgcttcatactgtctccctgtttttcttgataccagatctttataatggatttttcctttagacaggaacttctttgctgccgccttatccatcttttttccctggcttgcaaggaatttatcattcttccacaaggtaaaagcacagttccgatcagaacagtaaaagtttacttttccttccctgacatcagctccacaacggggacatttgccaatgacttctccttttgcttttccctgaaactgctctttcttttcttctgaaataccctgatatctggcaaccagttcctgcatcagctctgtaatcccatttaggaattcatctgctgtctctgtattctgggcaatgtgattcaatgccatttcccactctgctgtcatcttcggagatttaatctcatccggcagaaccgtaatcagcacattgccatcatctgtcggcaccagatttttcttttcccttttcacaaaaccagactgaatcagtttttcaatgattgctgcccttgttgctggagtacctagtcctttcttttctgtatcttcggtcagttcttcattccctgcacgttccatcgcagaaagcagggtatcttctgaaagcttttgtcaagggggtgcgtggatatttttcatattacttacgcagattctctctctgcttctgcctgaataatgcgtttcaatctgtcctcagcagtcaaaccgctactatggtcaaaaaacactttgactttataatttgttttgccttgcttaatcacaaaaactccatccggtttgtttttctctgaatggttatttggggtgggtagtgtactgttcacaatatttgtcatacgatattcctccttaaatgaaaaaagcccgacaaggaaaggtctgacaacgaagttccgacaacggacatcagaaaaccttttttctttatcgggcgatactatctttttactatttcctttttctttataatattggttgtcatggttgtcagagagggaaaagtgccgcaatatcaaggctttcgggatttttgcccgacaaccagaccgacaaccggctcgacaaccgaagcgacaacgggcttttatttttgcttcaaccattcttccggaagtcctaactgttccatttcctctgtcgggatttcttgaaaaccatccatgctgttgtcaggctcgttgtcgttcctgatacgctcccagcccttttgtcggcggtaaggctctggaaaatacctcggattgctgaacgccctccagcctgtgacagcgttattcataatgtcattgatctctcgcagttcccattgtttcggttcgtcataatcatgccccagtgcttccttataaagctgtttggaacagaccatgctcccggaatagcgttccaaatagtctaaaatctgtcctgcctttgtgtcctccggcataaagtccttttggtgggctttcagataagcattcatagccggactgaatctcagacggaaattgccgcttctgtaaatctccatagcttctgcccacatctgattgatatactctctggaagcctgttcatccgccaaaatatgaacctcagccctttcaggatagaccataaccggaacgaagcggcggttgcctgttcggtcaaggggaagaaagtcaagggtattagaagaacctccaaacacacattgtcgttttctgtctgccggatgtgtttcatagggtatcttataggtttccttttgtcggctcagaaaggacttgatttcttcaatgctcttagcgttggcggttgcaatcatttccgacatttcaataatccaatgcccctgcattttgcggtacacattttcatcatccagctttttcaagtcatcagagaaccaatcatcattgactgcaagcaaacggaagaaagaggactttccggctccctgaccgcctacaagacagagcataacctcaaatttgcaccccggcttaaaagctcgtgagatagcacccaacagaaacaacttcaatgcttcataggtgtaatcatctgtatcagaaccgagaaagtggtgcagacagaagcgtatgcgttccgttccgtcccattgcagggcattgagaaaatcgcagacagggtggtaacggttttcattggcaataaccgcaactgcgtctataattttcttctctacggtcaatccatagttttcttcaaaatataggagcagatatttcacatccacatccgtcaatgtcgggctgtcacgataccaaccgagtggcttcacaatgtcgattctttcggtcagaagattttttcggatagcccctttcaaaagtgggtcatattgcagaacacgcttataatttgcggcagtattataaaccttacctttctcgctctgctctaagctgtttcggatttcttctactgtgcatggttctgtctgctgacagttctgcaattcgctgttcaagtttcaacacctcctttctctgttctgccacaagtgcttttcgttcttccaatgaaccatacagaagaatatcaagtagatattcgatatagttcttcttatacagtgcttctgcaaacaggggattccattcctcatccggctgtttaggagcgtatttcttttcccattctctaagaagatgaaaataatccgtcagcaccttgtagcaatgattttctcctttttgatacttctgttccggtgtcggctcacgaatacgagggcggacactgggcttttgtcggctgtcatagttaagaccaaaatcttcagcaagtttgacagcagcttccctcagcccgataccgaatagcttcgctgtcagatcaacagcgtctccggttgctccgcagccaaaacagtaatagcgttcatccagcttcatactgggggacttatccgagtgaaacggacagcacaccatacctgtgcgacccactttcaagccataggcttctgcggcttgtcgggcagtaacattttcttttacaatttcaaatacattcatgtgactcctttcctgaaacgaaaaaagcacctgtcattttcaaaacgaaaatagcaagtgccttaaagttccatatttaattttaggtacaaaaaagcaggaaaccttttcggatctcctgcttagtaaagctgtgaagatttaattgtagtcagtttctcttataccatccgaaatttatactttaatgttctctcataacaaaaatcaattttgtcctccaacaaaaataccgtttgggggattatcccatataaaattatcctcagccacttcgctctctaatgcaatttcaattttatatatccccacattttgggcattttcatcatcctcactatacatataaaaattcatacaataccgttccttctctgtcaatatgagatacataccatccaattccgttttccttttaccatagttgctttcacttgatgatgcacaatcgccctcaaaactttggatactgccctcaatataatcgaaaaaagcagagatttcagtgtctaaattctcaatgttctttttgctttcttcggaaaatagagatttgagtttctctgaatcctgttgcttacatgcctcgataatttgttgacacatcttatccgtttcattttgttcagagctaaaccagtcattgaaatatttgttagagcagcctgttaaaccgagtataataatcacactgaaaagcaacagtactttcttcatataattacatcctttacttgataattgcaaaatcacttattggattaaggtcattacaaaaaatttcttactatcattatacttcatcaacctaaagaatggaagatattttcttgcttcctaaagcaaaagcacctgtcattttcaaaatgaaaacagcaagtgccttagagttccttatcctgctttttgtttttcgccggaattgttcggctgacttcacgctctgcaatttctttctttttgcggctcaactgctctataatggaacttttggctttcttcttgatttgctccgttccggcttttttgacctccggcttcatcagcgtggtttggattttctgaatggttgatttcatagcgtttgtgattctggcaatcacgccatccaatcgtttcgttgcatactcgatttctttctttgaagccttacgctcaggggagagaacccatgccttagactgctccaccagcttaatatcctccttgtgcgtttccagtttcacagtatcagcaacgacctcaaccgccttgtcataggcaatatcggcaacctcgtccaccagagcttccacatcttcaatcttcatcgtgagttcttccagcttttgctcctgtgctgacagttgctccttttgcttgaaaaggatataatcctgtttttccagataagcacgaccaccatattccggttcttcttccagttgtaagccatgctttttcgccacatcaaacagcagcactcggcaagctgaatcgaaagtcatcttgcggttattttttcttccgacaggcttctccggttccggcagttcaaaccccagtgcttccaaagccttttcctgttgtggggcaatctccccatattgattttcacagtcgaacacatgacgctcgtgaatatgaggggtacattcatccaagtgcagagcccaattcaggatatggacatgagaaccgaaacgctcatttacgatttccataaattctgtgacgatctcaatgagcaattccggcggaacatgattatcaagcgttccaatctgatagaccgtttcctctggacaggtctttttgcttttgagtaaatctccggtttccttatttctttcagggtgtcggttcttcacatttctttcgttctgcctggtcacaaaatcacgataccgctgacgataaaaaagctgttccacatcttcaaaagtggcagacagctcattttccttttcgggatttttgaaattgcggaagccattgtaacagtcccaatagagattttgtttggctcgttcttcgtcaatgtgttcgctgttggcaatgtcaaaactgcggtcattgtgcttcggattataaacgccattctttccggctcgtccattgtgccttgttaatttcacatgagttcctccttttctttttgatttccccgacaggggagaagggcagcgaagctgattccttgcggctttctgcgtcaagtaatacccagtactaagtggcgaaacgccacttaactgggcaaggctgccgcccttgacctgcacagggatattgcattccctgtacccatgcacaaagggttgcaccctctgtactcccgctcgaacaaactgacttcgccccgtctcaagctctgtcagttccttcggttttacaaaacagtccaccggactattttgcaaaaaagaaaaaccgacgcatgatcgctttacgctcaatacatcggtttcttcatctgaccttaacggtcatattcagttgtggcagattagccaatttgaaaaattattctggcacatctactgagtagctcagacaatcgcctcttttattgctttccaaatcgttataataccacatatacatcgttctaccatattcttcatattctataattccatctggcttttgaccctctacttctaatgagtaaatttctttatcatgtgcatagccaaaaacgaatctggtatctggataatttggatttaagtcttgttgaatatcacttattgttaaagataaatggataaattttttgaagtctcccccataagtggtatctggtgtagtggcagatggtgtggcatttacaaacgcatattgtgtactttcattttctatctgttttttgcagcgtgcaatcacaaaaccttgaacgggatcgttatcacttcctgctcgatagaaaatcgtatcatactgtttgccattccatatatgcaatatttcatcaacatgattaagaaaatcttctggagctgataaatcttcatgttctgcttttaagggggaattcaaaatagcttcttcgatagagttataatatgtaagtttagaatcgtcttttccattatctgtcaacttaaactcgatatactcatttcctttgttttcttcttccggaacataagtataacgaccattttcaatatggtcatcataatcaacaaacagtccaatacatatcagcactgcaaaaatcaaaaaaactattcctataacgattagcaatattttcaaaaattttttcatacaaaagtccaccttcttgcttcatttcagtaaattatatcataccgatatgaacaattcaatttacactctatcaagtagtttttttacttacctgtaacgcacatttctgcaaaatccatagtccccgatactttcctcacgggtgatatacagtcggaattctgtcagctcatgaaataagaaaaaccgacgcatgatcgctttacgctcaatacatcggtttcttcatctgaccttgacggtcatattcagttgtctaacatcgtactgttataaaatctatgtcatttacgatttttcttatgctgatttgctcagtaagattttacagggattcttcttctctctatatcctccataaattcactatcatcaacaccgctgtcaatagtgaataattttttgccattgacatatacacgaatagaatttcccttcatctcgcaatatgtaatatcttcaaagcgaaaagttctctttcttccaaaagttgaacgccatgtgatttcatctccgttcacttccagtttccacataatcatgttcaatgagccgattaaagaaacaataaagaaaatactaaaaccaattggtggcaataaatcatcttgttgaatagcactggctaccgtagctcccccaaaaagaaacaccgccaatacaaaaaacatagtaagtactttttcggtttttattatataatgcgtcctaattattccctttttctgttcttcctctcgttctttagctctcttttgttgaagatttacaagatatttcaaaagaagaagtacaactaaatagggacctatttgtgtaattatattcaaacacattcgtaaaaaattattcatttttgccctccatagttccagctatataaaaatgattgtttgaaatcgagtattaaaaacctcaatttttcatatctcattatacttcatcaacttaaagaatggaagaaaaaattttgtgtacagagttcctgttcaagccttgtaacgcacatttccgcaaaatccatagtccccgatactttcctcacaggcgataggcaacggtcaaaacatcaggtctgcacctgacattttaaccgcatatcagccctgattatcacattatccctgctggctgttcagcccatgctttttcgcatattcgctggctttccgtctgcgttcctcactgtaaggcggcaggaaacggatagacagacgggactttgccagctcataagaaacaccgccttgaacattggatttttccagtcggcaaaggtcagggtacttcttagcaaaagcagccaacctctttttcaatccggcgttgtgggtgtagatatttgccttgtcctcgccctcattaaagagaacgattgtttctttctcaatcttcgtcagtctcgtcatagcagccctccctatggtttttcaacacacgcagcttgcagtaaaagcagcgataccacctttcaacaccctcagcactcagcttgacggaaagcatataaaacagcttcttcgccactggatcgggtgcaagggcagctaccatacgcaaacgctcgacagttgctttcaggttcggacagccaaaggcataaagggcttccatttcattccggttcatcttcattgtgttttcctccttaaagtttgataaatgaaaagcgacagacacttcataaggaaatacctgtcgcttcgtttacgatacaaatttgttggttttggacttgataaaatcagcagtaaatcatttcctgtctgatgatttcttcggctcggttacggatagagttcatggactgtacccacaacatctgattgtctgctttcatggtttcggtcacgccctcggcttgtttcatctgctcaatgataaggctgcacctttccgttgcctgttcgtccaggtcagcaaggtaagtatgcagttcgccggataaacagagggcagagaaccttgtagggcggtactgctccaaatatgtcctgtgcagtctgccccacataccgatagggcggtgttcctccggtagcttcaagtccggcacatagtaatcgcccacaagaacatagtccagaccgttgcttttgtcatggattcgtgatttcaattctgtcatgctattttttctcctttcactttttgccgatttgatttgcttgtgacgttctgttcaacacacacattgctatcagaacttttttcttctgctatacgctcatgctccgcaaattcttttgatttctcacgaatctttttcatatacttacgattggattctcgttttctgcgaagtcgttccgcctctttttcagcagcaatcctttcttcctctgttggttcatgctgctccacaggtacttgaaattgcccgacatagttaagatatatctccacctctgtggtgcggtctgcaccttttccttgtggctcgtgaaccagaattttgtcgataaattcatttatcatggcaggagtaagttctgtaatattctcatactttttaaccagctttagaaaacgctccacattattttgaccgcctataatccgttgcatatcagcggtgtcagtctcaataatcttgttcagctcgttctgctcattttcataatcagtaagcatactctgaaaaagtctgtccggcaatcttccaatcacattatcttcatagattttcctgataagcatatccagttcgtgaactcgcttctgatttctttcaatgcggttttttacagtttcagaaacagcaatatctttcatcgccgattcttcttgcagagaataaacaaactcccgctcattcaaagaaacataatggcaagtctcctgtatggttttcagaatgatgcttttaagtgcttttgttgaaatatggtggcaagtacaatgtcggtcatacttctgataagcaagattatatgtggaacattcataacaatctgccggattggaataacttgtccttttttcgcctttggcagtatagtatattctttctcgccctttccgctgcctgtgattatacatcggcgcaccacaatcagcacagtaaatctttccggtcagaacattaggctcgcccataggatctgcttttcttacattctgtcttaacttttgagcaagcagccatgtttcttcatcgacaataggctcttgtgtatcatcaaaaaccacccaatcttccttatctgcccttttcgtctttttgtccttataggaatttttgaatgtcctgaaattgacagtctttccgatatactctggtcgggcaatcagagtagtaacctgatttcctcgccacatatacggattttctttgtcatagttgcttgcatgatttccaagtccctttttgccaagataataagatggtctttcaattttttcttctgaaagttctcttgctatctgataaggtccttttccctcaatagtcatgcgataaattctgcggactacttcagcagcttcttcatcaataatccaatggtcggggttttcggggtctttcaaatagccgtatggtgggatattacttgtatgagcgttgccggaagaacctctggatttcagtacagctttaattttcttacttgtgtccctgacaaaccactcattcatgatattcagaaaaggggcaaactcactggtttcttgacggtcactgtcaataccattattgattgctataaatcgaacttccttttctctaaacagaatgtcagtgaaaaaacctacttgcagatgatctctgccgattctggacatatctttgcagatacaggcagtgatttctccgtttttaacaccttcaacaagtctgttccatgaaggtctgtcaaaagtcgctccactccaaccatcatcggtaaaatgaacaagattcgtaaaaccatgtttcatagcataatcttcaagcatttgtttttgatgaactatactgttactctctccagcattatcatcatcacgagacagtctttcatacaaagcagtaatgccattgcttctatctttttttcttctcatgctgaactcctttcttcaattcctatccactccttacgctcacaaaatatcacatctgtgtactgtttcggtggctgtgtaaaatgctccgatacaaaagaatcacagggaccataatgcttgcctgcccagatatccagctccggctcttctttctcactctttacgccaaagaactgtttcattttattttcgattgccttgaatccttcctgctttgttttctttgccgtgagataaaacgtatgataattacaggtaatctggcttttatgactctcataaatataaggatctgcggttgctgtcagtaccctggcactgatcaggtacaaaatcttgcagtttcgttctttcagtttacctatatctgcctttgctacttccatggtcgggataatcgcatggtgatcagatactttctttgaatttaataccttactcacgtccggctgatattccaggctttcagcataaggcatttccccaagtaacatctgaatcagagtttctgtgctttctcccatctcatctgtcagatactggctgtctgttctcggataagtgacaagcttctgctcatacatctcctgcacggcatccaatgtctgctgtgcggtatagccaaacattctgttagcttccctctgcagggtggtcagatcataaagcttcggagggcggactgttttctctttcacatcatccttttccacttcgcacatccgctccatgcagtccgcagccactttatctgcatcctcttttttctgaaaatgctctgtaactgcatccatatcatcaaacttgatatgagccatataatatttttctttggtaaattccttgatcttctgatttcgatccacgatcatggcaagtgttggtgtctgcactcttccgactttcagattctggttatacagaacggaaaaaagacggctcgcattgattcccaccaaccagtctgcctttgccctgcaaagtgctgactgatagagactgtcataacacgaaccgtcttttaatgacgcaaatccatctttaattgcctgttcttccatggaagaaatccagagccgcttcatcggctttttacatcctgcctgctcatacaccagacgaaagattaactctccttcacgtcctgcatcagtagcacagatcacttcatctactttagaatctctcatcagtttctttaagattccaaattgctttttcgtgccttccaataccttgtgtttccaacactccggcacaatcggcagatcttcatatctccattttttatatttttcatcgtattccgatgcatcgcataatccaaccagatgtcctacgcaccaggaaacgatataaccgtttccctccacgtagccatcttttcttgttctggctccaagcacggaagccagtgccatcgcaaccgatggcttttctgcaatcactaatttcatttactcctgctcctcttcttcatcttccagtacatcatcattaaaatcttcatctctcaggatttccggttctgcactttcttcctgctcatctgcatcgtctacttcccgtttttctgactctgaatcttcggattcctcttcatcctcttccatctcatcctcgtcatcatattcatgctttggtttatagactttgaagtaataacctcctgccgcagctccgactgcaaccaatccgatcagcagataagtccctgctgaacttttgtcttctggcatctgaatgtcatcctctactttatctttctcatctgtctctgccgtttccggcttttcttcttcagcctgtttctctggttctgcataaacagtatctacttccggaagtgtcactgaatcagaaagtgtgaagttcatcagatctttctcactgacttctgtaaggaaatacacattatcctgagattttgaattgtcaataatcagatagaaaatcttaccactcttcgttgaaatggtataaaactcttttgtaccttccgtagctgttttggtaacggattctgccgtctcgccttctttattaagctgttcctcaatacctgttactgtccgatcatccacggttccttttgcatctgtcggctcagaagcctgtgcatcctgtggaagcggagaagtcgttgttttttcagtccccgtcgcatctgcactggtcgtagttgccattgcaccattgctgtcactggaagatttctgtttttctgcctgcttctttgcccattcatagtaaggattctgcaacacatacttttcagaagtatttccagcaccatctgttaccgtaatctcaatctgttttgtagtaaaatctttctgtgtcagttgcactctcagcattccatccttcaagtctgtataagtggtgccattgactgttaccgcagtaatcccggatactgtatcattcccctgaatcgtcagcacaccatctgtcagggaagcagtgagtgtcggtttttccgtgtcataacacttaatagagcgattctgctcatagacctttccctcaccatctgtcacacgcacatacactgtctgatttcctgtaatcgtgatacttccgcttcctgttacatcctgccaacttccatcttttcctgcttttgcttcaatcttcgctattgagaaaccttccggcatatgactggcatctaccgtaacagcaatggttgtttctccctgtttccagccatccggtttctcaatcgtaatcgcaggtgcggtattctcagctgcataagcagtctgtgtctggagcaaaggtgttgtcaggcaaagaaatgtcgttgctgcaagcaagcccttttttaccctgcttttagtaattgttctcttcttctgtttcattttttccagattcatcatcggcttttgtttcctccttctgtatttccaccctgccgggcagttcatttttcattctctttttgaaagcttccaattcaggaatactcatatccattgcacggataattcttacaatttccagattttccgcttctgtttttgcaatctccgcagccttgaaccgctttaagtctgcttcatatctagctttggatgcttccattttttccttggctttctcataatccgccgttgctttttcaagacttttcatcgcttctcctttccggacggctgatgcagccgcccttttttcttaccatcgtccaaatccatagaaatggctctgccagtatggtgaattgatggacgtgtactgcaccggatgaccgcaatggatcatctgaccattgcctacatagattccaatgtgcgttaccggaactcctgcatcataagtgcctgtaaaaaagatcagatctcccggctgtgcttctgactgagataccggcgtgcagatgtcatacagtccctgtgcagtcaatcttcctgtattccttacaccagagtttgtcaggcagtaacttacaaatccagaacagtcaaatccacttggagaatatccaccccacacatacggtgttcctagatatctcgctgcttcgttcaacaaacgctgtgccgcttcactggtgtattcattgccgccaaagcctgccccttctccagtttccagataaaagatcgggtttaagcgctctccatttttcagaagttcaatatgaagatggcttcctgtagaatttccagtatttcctacaagaccaatctcatcacctttcgtgacggatacacctgcagatacactccggctgcttaaatgtgcataccgcagttcatagcctttactgtccttgatcacaacataattgccatagctgtcgttataagcagaagttgtaaccgttccggtcagccctgccattacttttgttccctccggcgctccgatatccataccattatgaagctgatttgctcctgaaattggatgaatccgatatccataataacttgtcacactggaataccagttaaaatcaaccggtgtcgcaaacatctgtaaattacctttcgtatcgttataggcactgaacagttctttctggaaaaatcccagcctgtcctgacagatcgacatcagatttccgctgtttaaggtgacattcagcacatctacatctcttgtcctggtcacttccacttcctggcttccattatcatctgccagatagcattcccaggtcttatgaccatgtgcggatgctgccgcatgactgtcataatagacatcaaactgtacaccgtatcttgcgaaagctccggtatcttctaccgtatattcgacaccattcatgaccacctttgttcccattggaacaaacggattggaagcatctactgctaaggtatgattggctgttggatatgctccactggcagtcggtcctccactccaaataccacaacagattggacagttacaatatccgcttgttacaacctgtcccaaagattctccaactcttactgttgctgtctctgtcacagtttcattgactgcttcagtagtcagatgatattgctctgcaaacaatacatccagttccggcttgacctgttcaaaagtaaactcctcatactttgctgacagataactgatcaggataaacggatcatgctcaataggtccgatgttatatcggtattcctcatgtcccggttcttcagattccatgttgttaatccgctcctgcagattagcttccagctgtgtataatacagttccgcttcccggattgcttgatccgatgacagataactggttcccgtgtaagtgatcacattttgtaaaaacactgcagagcatgacgtgacattcgttataatcagaaacatcaatccgatcagaactgccacactgatatacaccttccggttttctttaaagaaattggtgactttgccgccaatcttcttgatataatcaatcgtaccttttgtagctgtacctacggtctgttcacttcgctttgctttggcataatcccgtttgatctgttgcttctgaatctgtttttttagcttcttctgctcctgacgggctgccgcctgtgtctgtttctctgcctgtctctccagtctgcttctctttctggaagccctctgtttccttcgtctggcacttctctgttccagccggtaaataccttcgcatccttcttccaacttatgggcaccttctactgccgcattatcgtcttcatttttactgatctcacggtgcaatgctgcggaagttgcacttcctgctttcttaacaacaaaagctttttctgttttcacagattccccttccccaaacttcaggcgggatttcttctttccagaaccctctccttcatttgcctgataaacctgtgccttcttggaatgctgctttgcttcctttttctttcttgcttcctcataagaaaactttttggctttttccttctgtttctgatgacggaaattgactccatccgtatccatctggttcaatttctccatatctttgtcatttttcacagaagcaccagtctcttcataagcaaatttcagacgctgtttctgctttggtttcttacttccaccattcttcttactccggctgtctcctctgttttctgaaagatccgcacgtttttctttcagtctccctgactggctggcttcagatttttccgcaaatcttgattcttttctgttctcagcacggattcttttccggttttgttgctttctattttgtccaaaatcctcactttggttctccgttcgcatcagttccggtgcatccctggatttttgcacagagggacgaatatttttcccactccgcttagactggcggggagacttatccacaaggttttctgctttttccccctgttttattcccatctgcacatcactggcacggttactgacacgaacagaagatttatccgtcaggttttcttccaccagaccatctttggtcatcttctggaccttcttatccctgactttcattctctgttctgccactgattactcctccttcttcggataccctttccctgcctgtaataaacagagaaaagcgatgccaaatacagcaccgccactaaaagttaatacatatgaaattgctcgtaacatggtcttctcctttgatttaacctgcttcggaagtttcctccaagcgggttgtcatgattttatagagggaattcttcgggaatctgtctacaaatggaataatgacatttccatagaacagaagtccttccccctcattactgttggttacataggacagctgggttggtgagatattcagctgttttgcaagaatctgccggtcaccggaagcctggttgagcatataaataaaatctgaattttcaaatatattctctatctccctggaagacaacaaatccttaatattctgggtgataccagttggaataccaccccatttacgaaatctcttccagatttccacactataagctgcagtctgctcttccttcaaaagaagatggaactcatccacatagtatctggtggacttatgggcagaacggttcatcgttaccctgttccagacctgatcctggattacgagcatcccaatctttttcagctgtttgccaagttctttgatgtcaaagcagacaatacggttattgatatccacgttcgtctgatggttaaatacattcaaagaacctgtaacatagatctccaatgaagtggccagtcgctgtgcttctggctcttcctgttttctcagaaggttgtataagtcctccaggattggcatcttctccggtattggattggcaaggtattcctgatatactaaccgaacacaacggtcaataatcgttttttctaccggctccagtccattctttccgccaacaatcaactcacacagagataaaataaaatctgcttttaatgacagcggattgtcttcctcggaataattcaggttcagatccatcggattgatatactggtcagataccggtgaaacccgaaccacctgtccatgcagcgcctgcacaagtgccgaatactcggcttctggatcgcagacaatgatatcgtcttccgtaatcagaaaacagttcgtaatttccctctttgctgaaaatgacttaccagaacctggtgtaccaagaatcagtccatttgggttcttcaggcgtttccgatcaaccatgatcatgttattggataacgcattcaatccataataaagagcttccccttcctgaaacagttcctgtgtcgtaaatggcacaaagattgcggttgatgatgtggtaagccctctctgaatttcaattcgattgactcccagtggaatacaggacataagtgctgcttcctgctgataatccagctgttttaaggaacagttatatttctgtgcgatcccctgcacctggaaaatattattatccagcttctgccgcttctttgcggtattcataaccagaaccgtcacaaggaacattcgctcatttctggactgcagatcttccagcaggtttttcgcctcttctccataggttacaaggtccgatggaagcacgtccatatcataaccggaacgtactgcccgcttctgctcttcaatcttcatcttatccagatctgaaatcttgctcttgatcatcttaatcgcagaactctggtcaatggactggatatgaatgttgacattgatgctgtcatccacatccaggaaatctgcaagcatccggtctgtcagctccggtgcaagaatctgcaggtaacttacacttcccatcgttcttcccatcaaaaatgtctgattcttggaaaagttaaaggaagtcggtgcaataaaatctttggtttttaatccggtttccggcagcatcttatactggaacttaaatggttcgatccgatcctggttgaacacatgatacagaatctcaagcctttccagtccattcaaggaatgtgcctgtgctcccagaaccttaaagttgtttaagatatctgtttcgattctttcaagtcttggtcttgctaccttcagactctctgcttcgattccaaaagtgatatacttcgtctttaccagaccattatttcccttggaaagctgatttttcagcatagtacggtactcttcacgaatggcattgaagtcatccgtctgatccggaatatcaatgcttttttcaaattctgccacatccacctgctgattgatgaaggacagctgcacactgatggaagaatcaaagtaatttaagaaatcacagtaattctcaaatatcgtggtcttatcctcgtttaaagcaagctgataattgatgtcgtaaaactgaatcgtcttggagaaaaaggtctttgtcacctggcagataccatcctgcaacatccgaatatacggaatactctgctgtgcagttgtaggaatgcttttctgtttcctgcggtcccgttcctgtttcttcttacgcttttcctgttctctttcttttctgctttttttgtttcttctttcctgacggtttcttttttccgccagggacagacgctcctgctgagtctcctgctttgtcttttttgccatccggcacaccctccttttttacaagggtggaaatctcctgataaaaattttctgtcttatatggtcttactgccggacagataaacttctgtcgaatgatatttgccaccactttttcaaagggaagtccgtctttttcatacattgccatgaagaaaaacggaagcatgatcgttaccatcaaaatggcagcaatactggaaccgattggttttctcatgaacagataaaacggaattcccacaactgcggcaagtgaaaagaaaatcagctgccgctttgtcagatttaatgctacttttgttttgaccttggtaaggtcttttggtactggtacatacgccatggtatgcgctcctttcctgcccgctagtgggcattgaatatagatttgctaaggcttccggtcttgaataatgaaaatgcaagaatcacggtataagccgctactgaaaacatagctgcatgaagatcactggatatggtcattgcatttactaaaactgcataaattcccacacagaccatcatgaagaatccctgaaatgccagtgcgaacaagccttttaaatagttgtttccgatattgccccattccttattggtcatggtggcaaacggaattggtgctatggaagtataaaggtaaatttctatcattcttccgaacaagattaccgtaatgataattgacagaatgtgcatggtaacactgatcaacatcgtttccatggatagcaggaacaaatcccctaactccatatcctccagggcatccacaatccgtgaaattgcttctgttgcatccaccgcagtgtttcctgatatcaccccggcggcattgttgaccacatgctggccaacatcaaagaccgccatcgtgatattgaacgtatttgtcaccagataaatagctacatacgctttgaagatccagaggaaaatattgtaagtctcaaattcatggaaattgtttttctgtgttaccatcgtgatcaattcatagcacaggacaaaggtgatgatcagtcccgcaatggggacaatcactgtttgggataaattctgaatcagattaaaaatccctgtattccatccctgcggtgtctgtcccacctgcccggctatggttcccacctgctcattgacagacgtgaacatgttatccaaacatgacttgataagcccgatcaggatatcctttatcgcttccgtaattctctcaatgatggtgttcatctaccactcctcttaagagaacaatgttgccagctgtggaatcagggtagttcccagcagcatgattccggcaccagccatcagctgtttgatgccctggctcttagcgccgggattgtcatttccatatccttccagaaggtttacgacaccccacacaccaagacctgcgccgattgcgactacaagagtttttaaagttgtaattgcactgctaaaaaatgccatatattcataaaccaaaactgacttctttcaagtgtttacgggaatgaaaaaacaccgactaaaaagccggcgcacctaatgtcagttattcctttcctcattatttttcgttcattcccaaggttactccgacagttctacatgaatcacttccacctcttcttcgggtttcggtgtgtactgcggatttaactctttctctactttgtaccggttcttctcgttttcatctgcaagaagccgatagtttttgtgtttcgtgatatcatatttatccgagaaaaatggtctggcaccacggatctgcaggatacattttcctccatccatgactgcaatctcatcttctgtcatcagctgtttgcctgttttctggtaattcaatccaaaagacttctgattactcctcgtctccgaagtgttatacaggtcaatggtttccttacccagaagctcactcatttcctttaatgtggtcttctctttcccaccaaggaataaagtcgtatcacagttgcccagaatggtatctgcactatccttatacattgcctttaactgactctgtgactgcaaaataatagaagcagagatttccctgcttcggatagttgcgatcagcttgtcaaactgaggaatttgtccgatgttggcaaactcatcagcgatgacacgcacatgcaccggaagtcttccaccatattcatcatctgccttatcgcaaagcagattgaaaagctgtgactgtaacatggcaatcacaaagttaaaggttgtatctgtgtcggacataatcaagaacaaggctgttttcctgtctccgatcttatccagttccatttcatcataagacatgatctcacgaagttctgcgatatcaaatggggcaagtctggctccacaggatatcaaaatacttttcgctgtctttccagccgccattttatattttttatactgtctgaccgcaaagtgctgcggatctctttcttccagttcctggaacatcatatccaccggattctgataagtttcatcctcttcacgggtttcgctttcgttcaaaagatccagaagggtattcagattcttttcctcttcatccccttcataccagataaaagcaatcagtgctgtgtacagcaatttctctgctttcacccaaaaatcttcggaagctttttccccttcgcctttggtattcacaatgattgttgtcaccagcttcaggatatctttttcagaccgtatataagcaaatggattgtaatgaagcgatttggaaaaattgatggtattcagaaccttaatcacatatggctcatgaaccacttttccagatttatctttcataatatttccattcttatctttcttaggcggtccctttgctaacatcttcccgcactcttcgatcagagtacctttcggatctgtaatgaccatggaacaattcatctgcatgaccgacggctttacaaaaaatcgtgtctttccggaaccactgccaccgatgaccacgatatttttatttctcgcatacttcggctgctttggtctgctctccatagtcagtgcttctgttgctgtcaacggaatattcatccagggatcatctgacatataaggcttgatatcctctgcagttccccatctggctgaaccatactcgattcctttccgaagtttctttgcatctgactgtttctgccaaactaatagtttcaaaacaactgcgacagtaactccaaccaatagatctctcaggtcaaaactcaacagaatccctgtaaaaatccgatctgcatgttccatcgcatataacagtttgttccctatatcttctccgggactgctcctgtataggcaggatgctcgatccgcataaaaagcggtcagaacatagggaagattcgtaagaaccagtttctttttatccagggcggacagcctgaccccagctttattcttccacttctgcatcagattattgccgttttgtttcttcatcggctctgttcctgatgtcggctctttactttgtccttcgtcttctttggcatcattgcccggtaagctgcaagacgcttatgaatggaaggtttattcgctttttgaatctgtttctgggaaaactcacggaaagcagcattgagggcatcctgatcacgtcccttgaaaaataccagataaaccggcggctctttgctcttgtcttttttcagagcataattgatcccatattttctggcataccgttcaaaggacttgatatttttgtccgtgatctcgatattgaccatcccggcattctgttttgccagctcttttaccgtgacctttccctgtttcggctgatttttctgtgctttcttctctactgatttctgcttctgatgacgcagatacgcaacaagaacctttttcaacaggtctgccgtaatcttagtagcccgaatacagaacgtgaccgttttctgagttacctcttcctgcatgacttttccctcctttcagcgattcaactgctgtccaaatctgtaatcatggcaatcaccccctttaatgaaaaaagacagattaaccggtaatcaggttctgcacctgtacgagtttttctgtcccttcttcttttctcttatcttctccaccacaatagatgggaacacacatttcaagtattctactgtaaatacgctgatgggcagtatccaaatctgtggacttcatttcattcagtcccagattcgttgttatgatcagcggaagcattttacaatagcggctgtctatcacattatagacctgctccaaagcaaactcggaatttcgttctattcccaagtcatcaataatcagcagcggataatccacaagattttgtataatctggttcttatctgcctgatagctggtcatttcatttaaaatcctggaaaagtttgtcatcatgacacgttctccctgttccaaaagtgcatttgcaatacagcctgcaaaaaagctcttcccggttccaaccggtcccatcaaaagcaatcctacattttttctcttcatatctgtccagttttctacatactgcctggcgattagtatcttctggttgcttccattgtcattttcaaatttccattcccagaatcttctttcccgaagtccgacggattttctctgataaagctgccgctgttcttcttcccgctgcatcttctcatccagttcctgcctggcttttacctcgcattcgcacaaacaggacactacatgctcaaaacccatcagactgactttcatctgttttctttttccacaggtgccacaatgaagacatccctcttcgtccagataatctgctgttactttgttttccatcacaggctttctccttcctgaaattcatatttatccattcctatcctggttccatccctttctgcccaaagacagattgttgcaaaatggttttgatactcttttccactggatttcatataaacagaaagatgatcaatccgtttctggtaatcccatggaaatagcgtcatcaactcctgcagttcagcttccgacagaacaacatttttaaatctaccatattgactgaatttttcttccaaagcgggtgtattgcccttactcttatcagtatgattcttttcagtcttatttatcttagtattacttccatccagattcttgcagtccggacttctatttttttgcgttccggacttccagtttcttgcaatccggatttccaattctttgcagtctggatttccagtttctggcattccagaaacaaagtatcttactggctttcctctactccgttttacaaaatttttcacatatatgacagagggacgattattcccctgccgataccgctcgatcaatccaatcccatgcacactatccagctcatatagaagctttgtcactgtcgtatgcgacattcgcaacagctcctgcaattctgcgatcgtgtaaatgatatagacataaccctcactgtcaatccagccatttttcttggacaggctgattcgatcaagcagaattccataaaggagctttgcgtctgtggacaggcttgcaaactctttttctgtgaacagagcttttggtatccgaaaaaaagaaaactggtcagattcttctgctctgaaatattcaaaatctgccataatattttcctactcttctacatcaaaatcacaatttgctgcactgcctgtaccatggcacatctcatcaaatacaaaattgaatgattgaatcatttcgtccaaataataatttctggccttcttgttacaagcatacatatcaccaataaagccttcatcattccccatcgcatgaacaagggtttccaggaccttcataaacttcttttttgaacagctttcatactgtctgttcacatatttctggatatctaacacacgagcaggattattttcattttcctccagaattccaaatgcaagatccataccaaactcatatccatcagccttaatttgatcaatatccatctctccaagctcatcctggtatcctcgcttttccattgcagttaaagacgtttcatattgatcaatatatcccatatccgcaatagtttcaaaaatatctctggatgctttcaccatcttatccataataatttctctttcagccagcggcatatttgccatgatagtatctaatgtcatcattgattcttcctccatctcattttcataaataccattgatataaaagtggttcgcctttccattgtttggaatgatacgcaccagtttaccaacctgaaccagttcctgtactgcctgatctactccataccgagtcgtattcaggtctttctttatttcacttttgggatagataacaaacagattcccgttatgatctacccagccattttgcaccgcaaatttcaaacgatccagaaataagctgtatagaatctttgctgtatttgacagatttttgtatttttccatctgaaacagcacctttggcacctgcagacaatctaccggcatatactccatcttactcattgattgtttcctccttctgtttgtacagcacttcggctgaattaatattgatttccagcatccctacaaacacctgatagtacagcaggcatatctgttcatcctctcttgccagatacaatccttccagttcattggacggatgtttcattccgtatactgcctgacagatatcatggattttctcacattccacacttctaagatgcatctccaaggtgtgattaaatctctgccagtcctccagtttctgatttactgccatcatgcactggaacagttccgctgcttcacatgctgctgacagcactacatttttgttgttgatacttccatcggcatttttcatatgccctaccatatacgcctgatctactgaaaccatcttttatcctcctctatctaaacggcatttcttcttccataccctctgggatctctaagaacccttccgcatcttctggaaacggtggtctgtcaaccatttttgcacctgcgaattcaatccggtttgcatacacttcggtggtatagatctttttcccagtatccttatcttcataattacctgtgacaatctcgccttccaccatgaccttcgttccctgcatcagataatctctggcaaattctgctttctttgcaaaagcctttaccggaatgaaactgacttcatcggaataatttcttctgactgccagaacaaacttggcaatcttatgaagtcctttttcattctccacttcgttgtatccgggatttcttactaatcgcccggaaataactgttgtattcattggcttacccctcctatgctttcattgatttgtaacagataccgatacatggtccacattttccataggcacatccgtaacattcatctttttccaactcttcctgcttcatttcatcggcaaacattcctaacagtgttgtgtaaatctttttcattgccaggaatttttcttctgctttttccatcttctctttgtaaaatgggatcagttcacgaagaactggatggaaacgttcattttcatcatcccaggcacaggttttcatcatacagcgtggctgtttctcataattgcccagataatatgggcagaacgtacagcctctttttttaacaattgccaccggaatcactggcatctgacttttgatttcctttgttacatgcttactttcaattcgctctctcatcttaaaaatcctccaagaatatatatatttgcaaaagggaattcccctgaattgcctgtttttaagcacaaaaaaagaggcagacttacgatttttattttcgcaagcctgcctcttatcaatctaatattctattttccaatgacataccgtataaacacgtatatcgctctgatcacatacactggaatcatgatgcttccaatcaatgctccaataatgacacttaatgcagccatcccaagtgttgctgtggtatccattcctctcggaattagaatcaaccgcattttatgtattccaaatggaagtccggcaataaatacccaccagaaccaatccgtctgcccactgaccttcataattgtttttgtcatccaaaaccagaataccataaatgccagtggcagaattgattttttaattacatcttcaatcgtcatctttttttctccctctgtctgattccttccgccacctcccgattaaggtttgccagtatttctctaaccacaggagaatccaatcgaaaggtttccagatctttctccgtaagctcccttccgttcgcatcatatcttcgtacaatttttaaagccatactttcacttccttcctgctgataatcctaatgttttcaacaaatgtttaaatttctctctttttatccgtttaacacgtatcttttctatctttttcagatagacttgtattctacttgccatatcttcattgttcattctttaccctctctttctgcccacgatgccagaagcataaatataatttcttccatctgagtctttgtatatgtctctggaaaatattgtttcaatttcttcgccggaatctgcacctgaactttttcaatactttcattcatgcaaatctggtcaatctctgaatacgtcaacatccgttcttttgaaatctgtttcaattcctttgcctgcttcatggacggtactatattgtgattatgcatatactgaagtaatatctgctgctcttcagttctcaaataggaaacttcaacagctgtattaaagggaagcttcttctcgtctgccaattctaaaaactctgcgatcaactctgtcagatgaatatatcgaagaatctgtctggaactatctcctgtattctgactgacttcttccgccgctaacttcttgccaacttggcaagaagttaaatcagaccgtttcccctgacgctttaacgcctcatatttcattttataagcgaatgccttttcgctgattagtagctcttctcgctgaatgttggaatctaccatgatcaccgtcgcttcgtcatctgtaatatctttgatgataaccggcattttctctaatcctgcaagttcacatgctcgttttcgccgatgaccagctacaagctcataaccaccggactctctcaaccgcacaataccgggaaccaacacgccatattgtgtaatgctttcagacaattcctccattttcttatcatcttttacttgaaatgggtgatttggaaacggatgaaggcttcctattgctatctcactgattccattggttgtctcttcgcttgttccaaacaacgcatcaagcggctgtaaggaaatgggtgttgctctttttttagatggcatctttcagcacctcctccgtcactctccgataagcttctgtagctttgcctttcggatcataagagaaaatactctgtccttctctgactgcctccttcattcttacggaaaatggaatataattatcaaagatattaatttgacttccatatacatttctgagaagttccatattattcctggcatcattcgtatgagcatccaccatcgtaaacagaattccaccgacttgcagcttcggattgatttgcttacggaccttaccgatcgtttttaataactgctgcaatcctttgattggcaggtaagacgcttcaaccggaattagtacttcatctgatgcagccagtgcattgattgtgatcattcccaatgatggcatacaatcaatgataattgcatcatattgatccttgataccatataaaatctgtttcaatacatattccctgctcattgcatttaccaactgtacttccgtacctgccagtccaatgttagaacagataatgtctattccttctgcctgatgcctgatataacagtctgaaggaatatcttcatctttcattactgtatccataagagctgtaagtgtttcattactttcatcacaatcacgatatccaaatcctgcggatacatcagactgtggatctgcatctacaatcaacactttcatattcttttgtgccaatcctactgctaaattagctgtacatgcggattttcccgttccccctttttggtttacaatagaaataattctagccattttttcatcacctttcaatcaataaaaatgaccgaatcagctaaacagattttcatccattacgagctaattcggtcctgtttttcgctattaaattgtaatatcaccactttcgtgatacagtaaaagcatctcagataaaagcggaaattttctttcatctgaataagttttttataaaaggtaggcctttccttcataaatttgttgattcgttgcaagtttttttcaggaccaaatcgactcaaccccttgtatttactgggtttccgttgatttagtcttattttatcatcatcatcccccattctcaatccacaccaatagaa

SEQ ID NO: 2 - skipped
